United States Patent
Cherry et al.

(10) Patent No.: US 10,464,973 B2
(45) Date of Patent: Nov. 5, 2019

(54) WAP GENES AND PROTEINS THAT IMPROVE BACILLUS COMPETITIVENESS

(71) Applicant: NOVOZYMES BIOAG A/S, Bagsvaerd (DK)

(72) Inventors: Barbara Cherry, Winters, CA (US); Randy Berka, Davis, CA (US)

(73) Assignee: NOVOZYMES BIOAG A/S, Bagsvaerd (DK)

( * ) Notice: Subject to any disclaimer, the term of this patent is extended or adjusted under 35 U.S.C. 154(b) by 0 days.

(21) Appl. No.: 15/773,291

(22) PCT Filed: Nov. 11, 2016

(86) PCT No.: PCT/US2016/061496
§ 371 (c)(1),
(2) Date: May 3, 2018

(87) PCT Pub. No.: WO2017/083623
PCT Pub. Date: May 18, 2017

(65) Prior Publication Data
US 2018/0319851 A1    Nov. 8, 2018

Related U.S. Application Data

(60) Provisional application No. 62/254,234, filed on Nov. 12, 2015.

(51) Int. Cl.
*C12N 15/75* (2006.01)
*C07K 14/32* (2006.01)
*C12Q 1/68* (2018.01)
*C12Q 1/689* (2018.01)
*C12R 1/07* (2006.01)

(52) U.S. Cl.
CPC ............. *C07K 14/32* (2013.01); *C12N 15/75* (2013.01); *C12Q 1/689* (2013.01); *C12R 1/07* (2013.01)

(58) Field of Classification Search
None
See application file for complete search history.

(56) References Cited

PUBLICATIONS

Anonymous, 2012, Uniprot accession No. K2I1Q7_BACAM.
Dunlap et al, 2012, Biological control 64(2), 166-175.
Dunlap et al, 2012, EBI Accession No. AFZ92725.
Dunlap et al, 2012, EBI Accession No. AFZ92726.
Dunlap et al, 2015, Int Sys Evol Microbiol 65, 2104-2109.
Koskiniemi et al, 2013, Proc Natl Acad Sci 110(17), 7032-7037.
Lee et al, 2012, J Bacteriol 194(24), 6934-6935.
Lee et al, 2012, NCBI Accession No. EKE48628.
Lee et al, 2012, NCBI Accession No. EKE48629.
Willett et al, 2015, J Mol Biol 427(23), 3754-3765.

*Primary Examiner* — Padmavathi Baskar
(74) *Attorney, Agent, or Firm* — Todd Sladek

(57) ABSTRACT

Disclosed are WapA and WapI proteins from *Bacillus amyloliquefaciens*, genes that encode the proteins, vectors that express the proteins, and cells constructed to express the proteins. Also disclosed are methods for introducing the vectors into cells, classifying WapA/WapI proteins into functional groups, and determining compatibility of strains expressing WapA/WapI proteins.

2 Claims, 6 Drawing Sheets
Specification includes a Sequence Listing.

WAP GENES AND PROTEINS THAT IMPROVE BACILLUS COMPETITIVENESS

CROSS-REFERENCE TO RELATED APPLICATIONS

This application is a 35 U.S.C. 371 national application of PCT/US2016/061496 filed Nov. 11, 2016 which claims priority or the benefit under 35 U.S.C. 119 of U.S. application No. 62/254,234, filed Nov. 12, 2015, the contents of which are fully incorporated herein by reference.

REFERENCE TO A SEQUENCE LISTING

This application contains a Sequence Listing in computer readable form, which is incorporated herein by reference.

BACKGROUND

Some bacteria contain genetic systems that may help the bacteria compete with other bacteria in the environment. One of these systems is called contact-dependent growth inhibition (CDI), in which one bacterium can inhibit growth of another bacterium after contact between the bacteria. These systems have been described in some Gram-negative genera (i.e., in some α, β and γ proteobacteria) and in a single Gram-positive species, *Bacillus subtilis*.

SUMMARY

Disclosed herein are genetic systems from *Bacillus amyloliquefaciens* that may help the bacteria grow and compete with other bacteria. The disclosed CDI-like systems include WapA and WapI proteins from *Bacillus amyloliquefaciens* subsp. *plantarum* and genes that encode the proteins. The systems encode a WapA protein that mediates growth inhibition of neighboring cells and a WapI protein that confers protection against growth inhibition from cells producing WapA. Genes encoding WapA/WapI proteins were found in about 78% of tested *Bacillus amyloliquefaciens* subsp. *plantarum* strains, but not in subsp. *amyloliquefaciens* strains. The *Bacillus amyloliquefaciens* subsp. *plantarum* WapA and WapI proteins clustered into 9 different "Wap Groups," based on identity between amino acid sequences. The data showed that a first *Bacillus* strain, that expressed a *Bacillus amyloliquefaciens* WapA protein, inhibited growth of a second *Bacillus* strain that did not express a *Bacillus amyloliquefaciens* WapI protein. The data also showed that expression of a *Bacillus amyloliquefaciens* WapI protein in the second *Bacillus* strain protected the second strain from the growth inhibition. In one example, the WapI protein expressed in the second strain was from the same Wap Group as the WapA protein in the first strain.

In one example, isolated polypeptides are disclosed that have amino acid sequences at least one of 90%, 95%, 97.5% 98.5%, 99.5% or 99% identical to the C-terminal 200 amino acids of a WapA (i.e., WapA-CT) protein. The WapA-CT polypeptides may be classified into at least Wap Groups 1, 2, 3, 4, 5, 6, 7, 8 or 9. The isolated polypeptides may be part of a WapA protein from *Bacillus subtilis*, *Bacillus amyloliquefaciens* or *Bacillus amyloliquefaciens* subsp. *plantarum*, or part of other proteins. The isolated polypeptides, or other protein to which the WapA-CT polypeptides are a part, may be functional to inhibit growth of *Bacillus* organisms that do not express a WapI protein, or do not express a WapI protein from the same Wap Group as the WapA-CT polypeptide. The *Bacillus* organisms that may be growth inhibited may be at least *Bacillus subtilis* and/or *Bacillus amyloliquefaciens*. Nucleotide sequences encoding the isolated polypeptides are also disclosed and these may be part of/encoded by a vector. Also disclosed, in the Sequence Listing of this application, are amino acid sequences of complete WapA proteins (SEQ ID NOs: 93-113) and nucleotide sequences (SEQ ID NOs: 72-92) that encode the proteins.

In one example, isolated polypeptides are disclosed that have amino acid sequences at least one of 90%, 95%, 95.2%, 96%, 96.4%, 96.6%, 98.8% or 99% identical to a WapI protein. The WapI polypeptides may be classified into at least Wap Groups 1, 2, 3, 4, 5, 6, 7, 8 or 9. The isolated polypeptides may be functional to protect *Bacillus* organisms against growth inhibition mediated by a WapA protein or WapA-CT polypeptide, or against growth inhibition mediated by a WapA protein or WapA-CT polypeptide from the same Wap Group as the WapI protein. The *Bacillus* organisms that may be protected may be *Bacillus subtilis* and/or *Bacillus amyloliquefaciens*. Nucleotide sequences encoding the isolated peptides are also disclosed and these may be part of/encoded by a vector.

Also disclosed are vectors that include nucleotide sequences that encode the isolated WapA-CT polypeptides, which may be part of a WapA or other protein, and/or that encode the isolated WapI polypeptides described above. The vectors may include nucleotide sequences that encode one or more WapI polypeptides/proteins from separate Wap Groups. The vectors may include nucleotide sequences that encode a WapI polypeptide/protein and a WapA polypeptide/protein, both from the same Wap Group. Also disclosed are methods for introducing the vectors into *Bacillus subtilis* or *Bacillus amyloliquefaciens* cells and bacteria expressing one or more of the vectors.

Also disclosed are bacteria constructed to express at least one WapI protein. The bacteria may be constructed to express 2, 3, 4, 5, 6, 7, 8, 9 or more WapI proteins, generally from different Wap Groups. Bacteria may also be constructed to express at least one WapI protein and at least one WapA protein, the WapI and WapA proteins may be from the same Wap Group. Bacteria constructed to express multiple WapI proteins, or one or more WapI and one or more WapA proteins, may express at least some of the multiple proteins from one or more vectors, and/or from polycistronic mRNAs. Methods for supplying to an environment, bacteria constructed to express one or more of WapA and/or WapI proteins are disclosed. The bacteria supplied may efficiently compete with other bacteria present in the environment. The bacteria supplied may inhibit growth of bacteria present in the environment.

Also disclosed are methods for obtaining a nucleotide sequence from at least part of a wapA or wapI nucleotide sequence from a *Bacillus amyloliquefaciens* organism, and classifying a WapA or WapI polypeptide or protein encoded by the nucleotide sequence, into a Wap Group. The organism may be supplied to an environment based on the classifying, and may be capable of WapA-mediated growth inhibition of at least one organism present in the environment. In one example, two or more Wap-compatible *Bacillus amyloliquefaciens* organisms may be placed in proximity to one another based on classifying the organisms into a Wap Group.

Also disclosed are methods for ascertaining Wap-compatibility of at least two *Bacillus amyloliquefaciens* strains by determining whether the strains encode one or both of a wapA and a wapI nucleotide sequence in their genomes, comparing the nucleotide sequences or amino acids encoded by the nucleotide sequences, and designating the strains as Wap compatible or Wap non-compatible based on the determining (if the nucleotide sequences are not present in at least one genome) or based on the comparing (if the nucleotide sequences are present in the genomes). At least two strains may be placed in proximity to one another if determined to be Wap compatible. Two compatible strains may be supplied to a plant. Also disclosed are compositions of a mixture of at least two *Bacillus amyloliquefaciens* bacteria determined to be Wap compatible using the above method.

Also disclosed are methods for identifying an amino acid sequence and/or nucleotide sequence from a *Bacillus amyloliquefaciens* bacterium that has identity to a Wap query sequence and classifying the amino acid sequence and/or nucleotide sequence from *Bacillus amyloliquefaciens* into a Wap Group.

BRIEF DESCRIPTION OF THE DRAWINGS

In the accompanying figures, which are incorporated in and constitute a part of the specification, disclosures related to *Bacillus* strains that have improved competitiveness, polypeptides and nucleic acids that encode the polypeptides for improved competitiveness, vectors encoding the polypeptides, bacteria that express the polypeptides, nucleic acids and vectors and methods of using the bacteria are disclosed. Changes, modifications and deviations from the disclosures illustrated in the figures may be made without departing from the spirit and scope of the invention, as disclosed below.

FIG. 1 illustrates an example sequence identity matrix for WapA-CT amino acid sequences from *Bacillus amyloliquefaciens* subsp. *planetarium* strains. The matrix was generated based on the ClustalW algorithm incorporated into the MegAlign program of DNAStar® [version 7.2.1 (1), 410]. In this example matrix, sequences with high identity values and low divergence are closely related.

Figure 2:
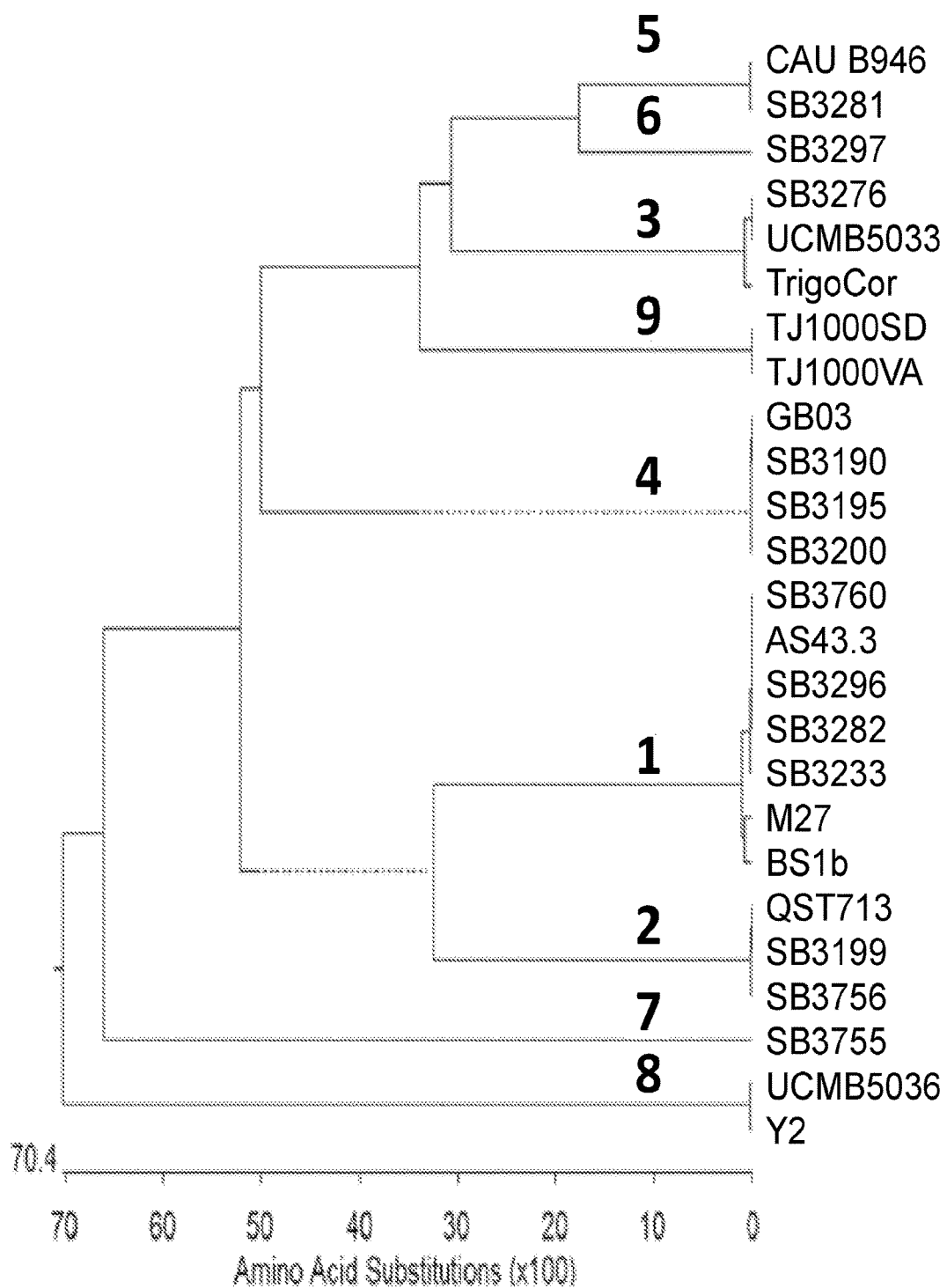
FIG. 2 illustrates an example phylogenetic tree/dendogram for *Bacillus amyloliquefaciens* subsp. *planetarium* WapA-CT amino acid sequences. The numbers (1-9) denote Wap Group assignments as described in the specification. The tree was generated using the ClustalW algorithm incorporated into the MegAlign program of DNAStar® [version 7.2.1 (1), 410].

FIG. 3 illustrates an example sequence identity matrix for WapI amino acid sequences from *Bacillus amyloliquefaciens* subsp. *planetarium* strains. The matrix was generated based on the ClustalW algorithm incorporated into the MegAlign program of DNAStar® [version 7.2.1 (1), 410]. In this example matrix, sequences with high identity values and low divergence are closely related.

FIG. 4 illustrates an example phylogenetic tree/dendogram for *Bacillus amyloliquefaciens* subsp. *planetarium* WapI amino acid sequences. The numbers (1-9) denote Wap Group assignments that correspond to those shown in FIG. 2. The tree was generated using the ClustalW algorithm incorporated into the MegAlign program of DNAStar® [version 7.2.1 (1), 410].

FIG. 5 illustrates an example phylogenetic tree for *Bacillus amyloliquefaciens* subsp. *planetarium* and *Bacillus subtilis* WapA-CT amino acid sequences. The numbers (1-9) and shading denote group assignments that correspond to those shown in FIG. 2. Groups 1-5 and 7-9 contain *Bacillus amyloliquefaciens* subsp. *planetarium* strains. Group 6 contains a *Bacillus amyloliquefaciens* subsp. *planetarium* strain and *Bacillus subtilis* strains. Unnumbered groups contain *Bacillus subtilis* strains. The tree was generated using the ClustalW algorithm incorporated into the MegAlign program of DNAStar® [version 7.2.1 (1), 410].

FIG. 6 illustrates data from an example growth experiment using strains FZB24 (no WapA, no WapI), SB3281 (contains WapA, contains WapI), and BaC0202 (FZB24 strain transformed with plasmid expressing WapI from SB3281). The x-axis indicates the strains used. The y-axis indicates CFU/ml (colony forming units/ml) for the strain indicated by the arrows at the top of the chart. Bars numbered 1-3 show growth of single strains (controls). Bars numbered 4-7 show co-culture of two strains.

DETAILED DESCRIPTION

Definitions

The following includes definitions of selected terms and phrases that may be used in the disclosure. Both singular and plural forms of the terms and phrases fall within the definitions.

As used herein, "amino acid sequence" means a linear sequence of individual amino acids in a polypeptide or protein.

As used herein, "C-terminal region" generally refers to a portion of a polypeptide or protein that includes a terminal amino acid that has a free carboxyl group. The other end of a polypeptide or protein includes a terminal amino acid that has a free amine group, and is called an N-terminal region. WapA-CT is considered to be an example C-terminal region of WapA.

As used herein, "classified" or "classifying," is related to designating a WapA or WapI protein, or portion of a WapA or WapI protein as a member of a specific Wap Group. Generally, classifying WapA/WapI proteins into a Wap Group is based on the amino acid sequence of all or part of a WapA/WapI protein or polypeptide, determination of pairwise amino acid sequence identities between the specific WapA/WapI protein and other known WapA/WapI proteins, and grouping together those sequences that are substantially identical.

As used herein, "compatible" or "Wap compatible" generally refers to a situation where, when two bacteria, herein *Bacillus amyloliquefaciens* or *Bacillus subtilis*, are placed together, growth of neither bacterium is inhibited by a WapA protein expressed by the other bacterium. Herein, under these conditions, the two bacteria are said to be compatible or Wap compatible. Generally, a compatible situation may occur between two of these bacteria when: i) neither of the two bacteria expresses a WapA protein, or ii) when one of the bacteria expresses a WapA protein and the other bacterium expresses a WapI protein, the WapI protein generally being from the same Wap Group as the WapA protein (i.e., the WapI protein expressed in one bacterium is a cognate pair of the WapA protein expressed in the other bacterium). In these situations, both bacteria retain viability (e.g., are not growth inhibited) when in proximity to one another (e.g., when they are capable of contacting one another). Generally, when bacteria are classified into a Wap Group, and two or more of the bacteria that are compatible are placed in proximity to one another, both bacteria are capable of surviving and/or growing/dividing.

As used herein, "constructed to express," refers to a bacterium that, at one point in time, did not express a specific polypeptide or protein, but which has been modified or manipulated to express the polypeptide or protein, and now does express, or is capable of expressing, the polypeptide or protein. Generally, a bacterium is constructed to express a specific protein by introducing a gene encoding the specific protein into the bacterium. In one example, a gene may be introduced into a bacterium using transformation by a vector encoding the specific protein to be expressed (e.g., the gene encoding the specific protein to be expressed may be said to be "part of" the vector).

As used herein, "encoding" or "encode" refers to a nucleotide sequence, generally DNA, that is capable of being transcribed into mRNA, and the mRNA translated, to yield a specific polypeptide or protein (i.e., the DNA sequence encodes the protein). For example, a DNA molecule that encodes a WapI protein will contain consecutive nucleotide codons in the DNA that, after transcription and translation, yield the WapI protein.

As used herein, "environment" means a particular physical location and/or set of conditions. In one example, an environment may be a closed or artificial environment. Closed or artificial environments may include an environment where microbes are grown. One type of closed or artificial environment may be a fermenter. In one example, an environment may be an open or natural environment. Open or natural environments may include a plot of land where crops are planted (e.g., soil), for example. Other environments may include plant seeds, roots, stems, leaves, etc. Other environments may include microbiomes, for example, of humans, animals or various environments animals. Other types of environments may exist.

Herein, "express" or "expressed" refers to production of a specific protein by a bacterium. For example, the phrase "bacterium X expresses a WapI protein" means that bacterium X produces a WapI protein. Bacterium X generally contains a gene that encodes the specific WapI protein (i.e., a wapI gene). The wapI gene would be transcribed into mRNA and the mRNA would then be translated into WapI protein in the bacterium.

As used herein, "functional to inhibit growth" generally refers to the ability of a WapA protein that is expressed by a bacterium, to inhibit growth of another bacterium that does not express a cognate WapI protein. A WapA protein that is functional to inhibit growth, as above, generally may also be said to mediate WapA growth inhibition. Herein, "inhibit growth," when referring to growth inhibition mediated by WapA, may include cells whose growth is inhibited are killed. In various examples, the growth inhibition may be complete or partial. In various examples, the growth inhibition may be at least 10%, 20%, 30%, 40%, 50%, 60%, 70%, 80%, 90%, or even 100% or at other levels, compared to growth of cells that are not growth inhibited.

As used herein, "functional to protect" generally refers to the ability of a WapI protein that is expressed by a bacterium, to protect that bacterium against WapA-mediated growth inhibition by a bacterium expressing a cognate WapA protein. In various examples, the protection against growth inhibition may be complete or partial. In various examples, the protection against growth inhibition may be 10%, 20%, 30%, 40%, 50%, 60%, 70%, 80%, 90%, 100% or at other levels, compared to cells that are growth inhibited.

As used herein, "introducing," when referring to a vector, means that the vector is caused to enter into a bacterial cell. In one example, a vector may be introduced into a cell by the process of bacterial transformation. A variety of other methods may be used.

As used herein, "is part of," when referring, for example, to a WapA-CT sequence that is part of a WapA or other protein, means that the amino acid sequence of the WapA-CT polypeptide is connected to or linked to another amino acid sequence, via peptide bonding, to form a WapA or other protein.

As used herein, "isolated," generally in reference to a molecule like a polypeptide, protein or nucleic acid, means that the molecule is not in close proximity to at least some substances normally found in close proximity to the molecule when the molecule is present in its natural environment. Molecules may be isolated from the natural environment, away from at least some of the substances normally found with the molecules, by purification methods.

As used herein, "mRNA" means messenger RNA.

As used herein, "non-compatible" or "Wap non-compatible" generally refers to a situation where, when two bacteria, herein *Bacillus amyloliquefaciens* or *Bacillus subtilis*, are placed together, growth of one or both of the bacteria is inhibited by a WapA protein expressed by the other bacteria. Herein, under these conditions, the two bacteria are said to be non-compatible or Wap non-compatible. Generally, a non-compatible situation may occur between two of these bacteria when: i) one bacterium expresses a WapA protein and the other bacterium does not express a WapI protein, or does not express a WapI protein from the same Wap Group as the WapA protein (i.e., the WapI protein expressed in one bacterium is not cognate to the WapA protein expressed in the other bacterium), or ii) when both bacteria express a WapA protein and neither expresses a WapI protein that is cognate to the WapA protein expressed by the other bacterium (i.e., the WapI protein expressed in each bacterium is not cognate to the WapA protein expressed by the other bacterium). In these situations, one or both of the bacteria will be growth inhibited (or may not retain viability) when in proximity to the other (e.g., when they are capable of contacting one another). Generally, when bacteria are classified into Wap Groups, and two or more of the bacteria that are non-compatible are placed in proximity to one another, one or both bacteria fail to survive/grow/divide.

As used herein, "nucleic acid" generally refers to a DNA or RNA molecule.

As used herein, "nucleotide sequence" means the linear sequence of individual nucleotides in a nucleic acid molecule.

As used herein, "obtaining a nucleotide sequence," generally of a DNA molecule, means to acquire a nucleotide sequence, as may be done when a nucleotide sequence is obtained from a database, or to determine the nucleotide sequence using various sequencing methods known in the art.

As used herein, "orthologue" refers to similar nucleotide sequences in two different species of organisms.

As used herein, "polycistronic mRNA" means an mRNA that encodes two or more polypeptides or proteins.

As used herein, "polypeptide" means a linear polymer of amino acids, of a length longer than a few amino acids, where the amino acids are connected to or linked to one another by peptide bonds. Polypeptide may refer to a protein.

As used herein, "protein" generally refers to the full length of a polypeptide or complete sequence of amino acids for a protein encoded by a gene.

As used herein, "sequence identity," is a term used to describe the relatedness of two amino acid or nucleotide sequences, when the sequences are compared to one another (i.e., pair-wise comparison). Sequence identity between two sequences is generally determined after the two sequences are aligned. After alignment, the identity of the amino acids (if polypeptide/protein) or nucleotides (if nucleic acid) at the same positions within the aligned sequences is determined. Generally, sequence identity is set forth as a percentage of amino acids or nucleotides within the two sequences being compared, that are identical at the same position within the aligned sequences. There are a variety of methods for determining sequence identity between two sequences which may, within limits, yield different determinations of percent sequence identity. In one example, different methods for determining sequence identity may use different techniques for aligning two sequences. Different alignment techniques may determine different sequence gaps. A sequence gap between sequences may occur when, for example, there are regions between two related sequences that do not align. In one example, gaps may occur because of deletions or insertions of consecutive amino acids or nucleotides within one of the two sequences being compared. The methods used herein for determination of sequence identity are described in this disclosure.

As used herein, "strain" refers to a species of bacteria. When two or more bacterial strains of the same species of bacteria are referenced, the separate strains generally have differences in the nucleotide sequences of their genomes between one another.

As used herein, "supplying" or "supplying to," as in reference to supplying a bacterium to an environment, means placing the bacterium in the particular environment. In this context, "placing" is a physical/mechanical act that results in the bacteria being located in the particular environment.

As used herein, "vector" refers to a nucleic acid molecule, generally DNA that encodes at least one polypeptide or protein, and is capable of being introduced into a bacterium such that the bacterium expresses the polypeptide or protein encoded by the nucleic acid molecule. Minimal vectors may include not much more than a nucleotide sequence encoding all or part of the polypeptide or protein that is to be expressed (e.g., synthetic genes). Other vectors may include the nucleotide sequence encoding the polypeptide or protein to be expressed, in addition to sequences directing transcription (e.g., transcriptional promoters and/or terminators), DNA replication in a bacterial cell (e.g., plasmids) and/or sequences encoding a virus (e.g., bacteriophage). A vector may encode multiple polypeptides or proteins. For example, a vector may encode multiple WapI proteins, a WapA protein and a cognate WapI protein, multiple cognate pairs of WapA and WapI proteins, and other combinations.

As used herein, "WapA" refers to proteins from the group that is generally exemplified by sequences referred to as WapA herein. Generally, the WapA proteins disclosed herein are from *Bacillus amyloliquefaciens*. WapA proteins are generally capable of functioning to inhibit growth of one or both of *Bacillus subtilis* and/or *Bacillus amyloliquefaciens* bacteria that do not express a WapI protein from the same Wap Group as the WapA protein.

As used herein, "wapA" refers to a nucleotide sequence (e.g., a gene) that encodes a WapA protein.

As used herein, "WapA-CT" generally refers to the 200 C-terminal amino acids of a WapA protein.

As used herein, "WapI" refers to a protein from the group that is generally exemplified by sequences referred to as WapI herein. Generally, the WapA proteins disclosed herein are from *Bacillus amyloliquefaciens*. WapI proteins generally are capable of functioning to protect one or both of *Bacillus subtilis* and *Bacillus amyloliquefaciens* bacteria against growth inhibition mediated by a WapA protein from the same Wap Group as the WapI protein.

As used herein, "wapI" refers to a nucleotide sequence (e.g., a gene) that encodes a WapI protein.

As used herein, "Wap Group" means a group of WapA molecules, generally from *Bacillus amyloliquefaciens*, that have high amino acid sequence identity between one another. Wap Group may also refer to a group of WapI molecules, from *Bacillus amyloliquefaciens*, that have high amino acid sequence identity between one another. Herein, the amino acid sequence identity between either WapA or WapI molecules that are part of the same Wap Group is normally at least about 90%, but may be at least 95% or greater. Generally, a WapI protein from a specific Wap Group is capable of protecting a *Bacillus subtilis* or *Bacillus amyloliquefaciens* bacterium from growth inhibition mediated by a WapA protein from the same Wap Group. WapA and WapI proteins from the same Wap Group may be referred to as "cognate" or "cognate pairs" and, therefore, WapI protects from growth inhibition mediated by cognate WapA. Herein, 9 *Bacillus amyloliquefaciens* Wap Groups are disclosed. It is likely that additional groups will be found as WapA/WapI proteins from more strains of *Bacillus amyloliquefaciens* are analyzed, and these additional groups are meant to be encompassed by this disclosure.

As used herein, "Wap query sequence" refers to a known Wap sequence or part of a Wap sequence (e.g., amino acid or nucleotide; e.g., WapA, Wap-CT, wapA, WapI, wapI), generally from *Bacillus amyloliquefaciens* or *Bacillus subtilis*, used for querying a database for related *Bacillus amyloliquefaciens* sequences.

Polypeptides and Nucleic Acids

The polypeptides and nucleic acids disclosed herein are generally identified using computer-based methods where a sequence is used to query databases that include amino acid sequence/nucleotide sequences from various *Bacillus amyloliquefaciens* strains. Currently undiscovered *Bacillus amyloliquefaciens* wapA/wapI and/or WapA/WapI sequences, which are encompassed by this disclosure, may be found using one or more of the sequences disclosed herein to query various sequence-containing databases, and detect the sequences after they have been entered into the databases. For the work described here, the query sequences were obtained from *Bacillus subtilis*.

In *Bacillus subtilis*, 4 different wapA sequences and 4 different wapI sequences were found in a study of multiple *Bacillus subtilis* strains (Koskiniemi, et al., 2013, Rhs proteins from diverse bacteria mediate intercellular competition, *Proc. Natl. Acad. Sci. USA* 110:7032-7037). In each of the *Bacillus subtilis* strains examined, a specific wapA sequence was found together with a specific wapI sequence. Therefore, specific wapA alleles co-segregated (e.g., the specific wapA and wapI alleles were found together) with specific wapI alleles in *Bacillus subtilis*.

Herein, to find wapA or WapA sequences in *Bacillus amyloliquefaciens*, wap nucleotide and/or Wap amino acid sequences from *Bacillus subtilis* were used to query *Bacillus amyloliquefaciens* sequences and/or databases containing *Bacillus amyloliquefaciens* sequences, for sequences with identity to the query sequence (i.e., *Bacillus amyloliquefaciens* orthologues of *Bacillus subtilis* sequences are queried; Examples 2 and 3). In one example, the query sequences can be one or more of the wap or Wap sequences from *Bacillus amyloliquefaciens* disclosed herein.

The databases queried may contain whole-genome nucleotide sequences of various *Bacillus amyloliquefaciens* strains. In one example, the *Bacillus amyloliquefaciens* genome sequences may be obtained from public databases. In one example, *Bacillus amyloliquefaciens* genome sequences may be determined by sequencing the genomes in the laboratory, using conventional methods. In the studies described herein, sequences were obtained using both methods (Example 1).

In one example of a query, a WapA sequence from *Bacillus subtilis* subsp. *subtilis* strain 168 (Genbank accession NP_391802) is used to query proteins from *Bacillus amyloliquefaciens* using a BlastP search, as described in Example 2. Table 1 shows the nucleotide sequences encoding the 200 C-terminal amino acids of the full-length WapA amino acid sequences. The encoded amino acid sequences are shown in Table 4.

TABLE 1 wapA sequences from *Bacillus amyloliquefaciens* subsp. *plantarum* that encode the 200 C-terminal amino acids of WapA

| Strain(s) from which sequence originated | Nucleotide sequence |
| --- | --- |
| SB3296, SB3760, AS43.3, SB3282 (SEQ ID NO: 1) | ATGGCCCGCTACTACGAACCAAGAAACGGCGTGTTCTTAT CACTAGACCCAGACCCGGGCAGTGACGGCGATTCGCTGGA TCAGAATGGGTATGCATACGGAAACAACAACCCAGTCATG AACGTCGATCCGGATGGGCATTGGGTGTGGCTTGTGGTAA ATGCCGGATTTGCAGCCTATGATGGATATAAAGCATATAA ATCAGGTAAAGGATGGAGAGGTGCAGCCTGGGCTGCAGCT TCGAACTTTGGTCCTGGGAAAATATTTAAGGGTGCTAGTC GGATTTATAAAGCTGCTAAAACATATAAACTATCTAGAAA AAGTGTACGGGCTAGAAGGGCCTACTCAAGTTATAGGGAT ATAACTGGAAAAACCTCTAGGTTCAAAAATTATTCTACTA ATGTAAGAAGAAGAACTTTTGAAAAAAATTTAAGAAGACA AGGATGGAGAAAATCAGTTCATCATGGGGGTGTTATCACT ATGACGAAAAATGGGAATAAGTATTCCCTAAGGAAACATG CTAAGTCAAGTCCTTATCCAACCGCGGAATATACACCTAA AGGTAGAAAAAAATTCACACACAAATCAGAATGCGACAT TAA |
| SB3233 (SEQ ID NO: 2) | ATGGCCCGCTACTACGAACCAAGAAACGGCGTGTTCTTAT CACTCGACCCAGACCCGGGAAGTGACGGCGATTCTTTAGA TCAGAATGGATATGCATACGGAAACAACAACCCGGTGATG AACGTCGATCCTGACGGGCATTGGGTGTGGCTTGTGGTAA ATGCCGGATTTGCAGCCTATGATGGATATAAGGCCTATAA ATCAGGTAAAGGATGGAGAGGTGCAGCCTGGGCAGCGGCT TCGAACTTTGGTCCTGGGAAGTTATTTAAGGGTGCTAGTC GGATTTATAAAGCTGCTAAAACATATAAACTATCTAGAAA AAGTGTACGGGCTAGAAGGGCCTACTCAAGTTATAGGGAT ATAACTGGAAAAACCTCTAGGTTCAAAAATTATTCTACTA ATGTAAGAAGAAGAACTTTTGAAAAAAATTTAAGAAGACA AGGATGGAGAAAATCAGTTCATCATGGAGGTGTTATCACT ATGACGAAAAATGGGAATAAGTATTCCCTAAGGAAACATG CTAAGTCAAGTCCTTATCCAACCGCGGAATATACACCTAA AGGTAGAAAAAAATTCACACACAAATCAGAATGCGACAT TAA |
| BS1b (SEQ ID NO: 3) | ATGGCCCGCTACTATGAGCCAAGAAACGGCGTATTCTTAT CACTAGACCCAGACCCGGGCAGCGACGGAGATTCGCTCGA TCAGAATGGGTATACTTATGGAAACAACAACCCAGTCATG AACGTCGATCCGGATGGGCATTGGGTGTGGCTTGTGGTAA ATGCCGGATTTGCAGCCTATGATGGATATAAGGCATATAA ATCAGGTAAAGGATGGAGAGGTGCAGCCTGGGCAGCGGCT TCGAACTTTGGGCCTGGGAAGTTATTTAAGGGTGCTAATC GGATTTATAAAGCTGCTAAAACATATAAACTATCTAGAAA AAGTGTACGGGCTAGAAGGGCCTACTCAAGTTATAGGGAT ATAACTGGAAAAACTTCTAGGTTCAAAAATTATTCTACTA ATGTAAAAGAAGAACTTTTGAAAAAAATTTAAGAAGACA AGGATGGAGAAAATCAGTTCATCATGGGGGTGTTATCACT ATGACGAAAAATGGGAATAAGTATTCCCTAAGGAAACATG CTAAGTCAAGTCCCTATCCAACCGCGGAATATACACCTAA AGGTAGAAAAAAATTCACACACAAATCAGAATGCGACAT TAA |
| M27 (SEQ ID NO: 4) | ATGGCCCGCTACTACGAACCAAGAAACGGTGTATTCTTAT CACTAGACCCAGACCCGGGCAGCGATGGGGATTCTTTAGA TCAGAATGGATATGCATACGGAAACAACAACCCGGTGATG AATGTTGATCCAGATGGGCATTGGGTGTGGCTAGCCATTA ACGCCGGCTTTGCGGCTTATGACGGATATAAGGCATATAA ATCAGGTAAAGGATGGAGAGGTGCAGCCTGGGCAGCGGCT TCGAACTTTGGGCCTGGGAAGTTATTTAAGGGTGCTAATC GGATTTATAAAGCTGCTAAAACATATAAACTATCTAGAAA AAGTGTACGGGCTAGAAGGGCCTACTCAAGTTATAGGGAT ATAACTGGAAAAACTTCTAGGTTCAAAAATTATTCTACTA ATGTAAAAGAAGAACTTTTGAAAAAAATTTAAGAAGACA AGGATGGAGAAAATCAGTTCATCATGGGGGTGTTATCACT ATGACGAAAAATGGGAATAAGTATTCCCTAAGGAAACATG |

TABLE 1 -continued wapA sequences from *Bacillus amyloliquefaciens* subsp. *plantarum* that encode the 200 C-terminal amino acids of WapA

| Strain(s) from which sequence originated | Nucleotide sequence |
|---|---|
| | CTAAGTCAAGTCCCTATCCAACCGCGGAATATACACCTAA<br>AGGTAGAAAAAAATTCACACACAAAATCAGAATGCGACAT<br>TAA |
| SB3199 (SEQ ID NO: 5) | CGCTACTACGAACCAAGAAACGGCGTGTTCTTATCACTAG<br>ACCCAGACCCGGGCAGTGACGGCGATTCGCTGGATCAGAA<br>TGGGTATGCATACGGAAACAACAACCCAGTCATGAACGTC<br>GATCCGGATGGGCATTGGGTGTGGCTTGTGGTAAATGCCG<br>GATTTGCAGCCTATGATGGATATAAAGCATATAAATCAGG<br>TAAAGGATGGAGAGGTGCAGCCTGGGCTGCAGCTTCGAAC<br>TTTGGGCCCGGGAAAGTGTTTAAAGGTGCTAAGAAGGCTT<br>TGGGATTTGCGAAGGCCGCCAAGAAGTATTTAAAACCTGG<br>TAAATACGCTAGAAGGTCAATTCCTGCAAGAAGTACAAGT<br>AGCAGGTTAAATAAAAGGAAAGAAGAGTATTAAACAAAA<br>TTGGGAATAAATATGGCTGTCATACTTGTGGTAGAAGGCA<br>CCCTGGAACTAAAAGCAGAAATTGGATTGCGGATCACCAA<br>CCAGTATCAAAATTAAGGAAGAAAGGCCAGCGACAAAGGC<br>TATATCCTCATTGTCAAACTTGTTCACGAAAACAAGGAGG<br>ATATACTAGTGCTATTCTGAGAAAAAGACATCAACGGAGG<br>TGA |
| SB3756 (SEQ ID NO: 6) | CGCTACTACGAACCAAGAAACGGCGTGTTCTTATCACTAG<br>ACCCAGACCCGGGCAGTGACGGCGATTCGCTGGATCAGAA<br>TGGGTATGCATACGGAAACAACAACCCAGTCATGAACGTC<br>GATCCGGATGGGCATTGGGTGTGGCTTGTGGTAAATGCCG<br>GATTTGCAGCCTATGATGGATATAAAGCATATAAATCAGG<br>TAAAGGATGGAGAGGTGCAGCCTGGGCAGCGGCTTCGAAC<br>TTTGGGCCCGGGAAAGTGTTTAAAGGTGCTAAGAAGGCTT<br>TGGGATTTGCGAAGGCCGCCAAGAAGTATTTAAAACCTGG<br>TAAATACGCTAGAAGGTCAATTCCTGCAAGAAGTACAAGT<br>AGCAGGTTAAATAAAAGGAAAGAAGAGTATTAAACAAAA<br>TTGGGAATAAATATGGCTGTCATACTTGTGGTAGAAGGCA<br>CCCTGGAACTAAAAGCAGAAATTGGATTGCGGATCACCAA<br>CCAGTATCAAAATTAAGGAAGAAAGGCCAGCGACAAAGGC<br>TATATCCTCATTGTCAAACTTGTTCACGAAAACAAGGAGG<br>ATATACTAGTGCTATTCTGAGAAAAAGACATCAACGGAGG<br>TGA |
| QST713 (SEQ ID NO: 7) | CGCTACTACGAACCAAGAAACGGTGTATTCTTATCACTAG<br>ACCCAGACCCGGGAAGTGACGGCGATTCTTTAGATCAGAA<br>TGGATATGCATACGGAAACAACAACCCAGTCATGAACGTC<br>GATCCGGATGGGCATTGGGTGTGGCTTGTAGTAAATGCCG<br>GATTTGCAGCCTATGATGGATATAAGGCCTATAAATCAGG<br>TAAAGGATGGAGAGGTGCAGCCTGGGCAGCGGCTTCGAAC<br>TTTGGGCCTGGGAAAGTGTTTAAAGGCGCTAAGAAGGCTT<br>TGGGATTTGCGAAGGCCGCCAAGAAGTATTTAAAACCTGG<br>TAAATACGCTAGAAGGTCAATTCCTGCAAGAAGTACAAGT<br>AGCAGGTTAAATAAAAGGAAAGAAGAGTATTAAACAAAA<br>TTGGGAATAAATATGGCTGTCATACTTGTGGTAGAAGGCA<br>CCCTGGAACTAAAAGCAGAAATTGGATTGCGGATCACCAA<br>CCAGTATCAAAATTAAGGAAGAAAGGCCAGCGACAAAGGC<br>TATATCCTCATTGTCAAACTTGTTCACGAAAACAAGGAGG<br>ATATACTAGTGCTATTCTGAGAAAAAGACATCAACGGAGG<br>TGA |
| UCMB5033 (SEQ ID NO: 8) | GACGAAGAAACCGGCCTGTACTATCTCATGGCCCGCTACT<br>ACGAGCCAAGAAACGGCGTATTCTTATCACTCGATCCAGA<br>CCCGGGAAGCGACGGAGATTCGCTGGATCAGAATGGATAT<br>GCATACGGAAACAACAACCCAGTCATGAACGTCGATCCGG<br>ATGGGCATTGGGTGTGGCTTGTAGTAAATGCCGGATTTGC<br>AGCCTATGATGGATATAAGGCCTATAAATCAGGTAAAGGA<br>TGGAGAGGTGCAGCCTGGGCAGCGGCTTCGAACTTTGGTC<br>CTGGGAAGTTATTTAAGGGTGCTAAAAGGGTTTATAAAGC<br>GGTTCATTCTGTCTATGTTTTAAAAAAGGAAAGAAAGTT<br>GTTTATGTCGGAAGATCAAAGAATCTAAAAAAACGAGCTG<br>CTGTTCATAAAAAGAATCATCCAGATACGCGAATGGTTAA<br>GAAAAGAGGAGGATTAACTTATGCTCAAGCAAGAGGCTTA<br>GAGCATCGGTATTATTTAAAGTATGGAGGCAAGAAAAAAC<br>TTCGAAATAAAATCAGGCCAATAAGTCGTAAAAATAAAAA<br>ATATAAATATTATATGAGTTCTTCAAGAAAATTTTATAAA<br>TAG |
| SB3276 (SEQ ID NO: 9) | GACGAAGAAACCGGCCTGTACTATCTCATGGCCCGCTACT<br>ACGAGCCAAGAAACGGCGTATTCTTATCACTAGACCCAGA |

TABLE 1 -continued wapA sequences from *Bacillus amyloliquefaciens* subsp. *plantarum* that encode the 200 C-terminal amino acids of WapA

| Strain(s) from which sequence originated | Nucleotide sequence |
|---|---|
| | CCCGGGCAGCGACGGAGATTCTTTAGATCAGAATGGATAT<br>GCATACGGAAACAACAACCCGGTGATGAACGTCGATCCTG<br>ACGGGCATTGGGTGTGGCTTGTGGTAAATGCCGGATTTGC<br>AGCCTATGATGGATATAAGGCCTATAAATCAGGTAAAGGA<br>TGGAGAGGTGCAGCCTGGGCAGCGGCTTCGAACTTTGGTC<br>CTGGGAAGTTATTTAAGGGTGCTAAAAGGGTTTATAAAGC<br>GGTTCATTCTGTCTATGTTTTAAAAAAAGGAAAGAAAGTT<br>GTTTATGTCGGAAGATCAAAGAATCTAAAAAAACGAGCTG<br>CTGTTCATAAAAAGAATCATCCAGATACGCGAATGGTTAA<br>GAAAAGAGGAGGATTAACTTATGCTCAAGCAAGAGGCTTA<br>GAGCATCGGTATTATTTAAAGTATGGAGGCAAGAAAAAAC<br>TTCGAAATAAAATCAGGCCAATAAGTCGTAAAAATAAAAA<br>ATATAAATATTATATGAGTTCTTCAAGAAAATTTTATAAA<br>TAG |
| TrigoCor (SEQ ID NO: 10) | GACGAAGAAACCGGCCTGTACTATCTCATGGCCCGCTACT<br>ACGAGCCAAGAAACGGCGTATTCTTATCACTAGACCCAGA<br>CCCCGGGCAGTGACGGCGATTCTTTAGATCAGAATGGATAT<br>GCATACGGAAACAACAACCCGGTGATGAACGTCGATCCTG<br>ACGGGCATTGGGTGTGGCTTGTGGTAAATGCCGGATTTGC<br>AGCCTATGATGGATATAAAGCATATAAATCAGGTAAAGGA<br>TGGAGAGGTGCAGCCTGGGCAGCGGCTTCGAACTTTGGTC<br>CTGGGAAGTTATTTAAGGGTGCTAGTCGGGCTTATAAAGC<br>GGTTCATTCTGTCTATGTTTTAAAAAAAGGAAAGAAAGTT<br>GTTTATGTCGGAAGATCAAAGAATCTAAAAAAACGAGCCG<br>CTGTTCACAAAAAAAACCATCCAGATACGCGAATGGTTAA<br>GAAAAGAGGAGGATTAACTTATGCTCAAGCAAGGGGCTTA<br>GAGCATCGGTATTACTTAAAGTATGGAGGTAAGAAAAAAC<br>TTCGAAATAAAATCAGACCAATAAGTCGTAAAAATAAAAA<br>ATATAAGTATTATATGAGTTCTTCAAGAAGATTTTATAAG<br>TAG |
| GB03 (SEQ ID NO: 11) | TACTACGAACCAAGAAACGGTGTATTCTTATCACTAGACC<br>CAGACCCGGGAAGTGACGGCGATTCTTTAGATCAGAATGG<br>ATATGCATACGGAAACAACAACCCAGTGATGAATGTTGAT<br>CCAGATGGGCATTGGGTGTGGCTTGTGGTAAATGCCGGAT<br>TTGCAGCCTATGATGGATATAAGGCCTATAAATCAGGTAA<br>AGGGTGGAGAGGTGCAGCCTGGGCAGCGGCTTCGAACTTT<br>GGTCCTGGGAAGTTATTTAAGGGTGCTAGTCGGGTTTATA<br>AAGCTACCCAACAAATGAGTAGGAGGGCTTCATTCAGGGC<br>TGCTAAACGGGCTGCCGGAATACCTACTTCTTCTCAATAT<br>AAAACACATAAAAAAGTATACGATGGTAGTAGCGAGCATA<br>GAACTGTATATTCTTTTGGTAGAGTTGGAAGAGGAAGTCA<br>TAAAAAATATGTGGTACTTCATAAACATGATAAACGAGGT<br>AGAGGGCCCCATTTTCATGGTGTTGGAAAAGGTAGAAGTC<br>CCtTGAAAAAAGGGAGGTACAATCAACtTAAAGGACATTA<br>TCCAGAACATTTTAAAGGATATAGAACAAAAAGAAGGAGA<br>TAG |
| CAU B946 (SEQ ID NO: 12) | ACCGGCCTGTACTATCTCATGGCCCGCTACTACGAACCAA<br>GAAACGGTGTATTCTTATCACTAGACCCAGACCCGGGCAG<br>CGATGGGGATTCTTTAGATCAGAATGGATATGCATACGGA<br>AACAACAACCCGGTGATGAATGTTGATCCAGATGGGCATT<br>GGGTGTGGCTAGCCATTAACGCCGGCTTTGCGGCTTATGA<br>CGGATATAAGGCATATAAATCAGGTAAAGGATGGAGAGGT<br>GCAGCCTGGGCAGCGGCTTCGAACTTTGGTCCTGGGAAGT<br>TATTTAAGGGTGCTAAAAGGGTTTATAAGTTTGCGAGCAG<br>TTCCAGAAAAGTAAAGCAAATTGACTGGAAACATATAAAG<br>AAGGGTCACTCACCTAAATCTAAAATCCCTAATAAAGGAA<br>AATTCAAGAGCAATAGAGCAATGAAAAGAACGACCAGACA<br>CACATTAAAAAGAGGAAAAGCTAGACCAGGTCATTCAGGT<br>GCTACTGTATACGAAAAAAAATTTAAAAGGTATGTTGGAA<br>TAAATAGTAGGGGAAGAAGACAAAAAGGGTTAGAGTGGT<br>TGTTCAGCCGAATGGGAAACTGAGAACAAGTTTTCCGTAC<br>TGA |
| SB3190, SB3195, SB3200 (SEQ ID NO: 13) | TACTACGAGCCAAGAAACGGCGTATTCTTATCACTCGATC<br>CAGACCCGGGAAGCGACGGAGATTCGCTGGATCAGAATGG<br>ATATGCATACGGAAACAACAACCCAGTCATGAACGTCGAT<br>CCGGATGGGCATTGGGTGTGGCTTGTAGTAAATGCCGGAT<br>TTGCAGCCTATGATGGATATAAGGCCTATAAATCAGGTAA<br>AGGATGGAGAGGTGCAGCCTGGGCAGCCGCTTCGAACTTT<br>GGTCCTGGGAAGTTATTTAAGGGTGCTAGTCGGGTTTATA<br>AAGCTACCCAACAAATGAGTAGGAGGGCTTCATTCAGGGC |

TABLE 1 -continued wapA sequences from *Bacillus amyloliquefaciens* subsp. *plantarum* that encode the 200 C-terminal amino acids of WapA

| Strain(s) from which sequence originated | Nucleotide sequence |
|---|---|
| | TGCTAAACGGGCTGCCGGAATACCTACTTCTTCTCAATAT<br>AAAACACATAAAAAAGTATACGATGGTAGTAGCGAGCATA<br>GAACTGTATATTCTTTTGGTAGAGTTGGAAGAGGAAGTCA<br>TAAAAAATATGTGGTACTTCATAAACATGATAAACGAGGT<br>AGAGGGCCCCATTTTCATGGTGTTGGAAAAGGTAGAAGTC<br>CCTTGAAAAAAGGGAGGTACAATCAACTTAAAGGACACTA<br>TCCAGAACATTTTAAAGGATATAGAACAAAAAGAAGGAGA<br>TAG |
| SB3281 (SEQ ID NO: 14) | ACCGGCCTGTACTATCTCATGGCCCGCTACTACGAACCAA<br>GAAACGGTGTATTCTTATCACTAGACCCAGACCCGGGAAG<br>TGACGGCGATTCTTTAGATCAGAATGGATATGCATACGGA<br>AACAACAACCCGGTGATGAATGTTGATCCAGATGGGCATT<br>GGGTGTGGCTAGCCATTAACGCCGGCTTTGCGGCTTATGA<br>CGGATATAAGGCATATAAATCAGGTAAAGGATGGAGAGGT<br>GCAGCCTGGGCAGCGGCTTCGAACTTTGGTCCTGGGAAGT<br>TATTTAAGGGTGCTAAAAGGGTTTATAAGTTTGCGAGCAG<br>TTCCAGAAAAGTAAAGCAAATTGACTGGAAACATATAAAG<br>AAGGGTCACGCACCTAAATCTAAAATCCCTAATAAAGGAA<br>AATTCAAGAGCAATAGAGCAATGAAAAGAACGACCAGACA<br>CACATTAAAAAGAGGAAAAGCTAGACCAGGTCATTCAGGT<br>GCTACTGTATACGAAAAAAAATTTAAAAGGTATGTTGGAA<br>TAAATAGTAGGGGGAAGAAGACAAAAAGGGTTAGAGTGGT<br>TGTTCAGCCGAATGGGAAACTGAGAACAAGTTTTCCGTAC<br>TGA |
| SB3297 (SEQ ID NO: 15) | GGCCTGTACTATCTCATGGCCCGCTACTACGAGCCAAGAA<br>ACGGCGTATTCTTATCACTAGACCCAGACCCGGGCAGTGA<br>CGGCGATTCGCTGGATCAGAATGGGTATGCATACGGAAAC<br>AACAACCCAGTCATGAACGTCGATCCGGATGGGCATTGGG<br>TGTGGCTTGTGGTAAATGCCGGATTTGCAGCCTATGATGG<br>ATATAAAGCATATAAATCAGGTAAAGGATGGAGAGGTGCA<br>GCCTGGGCTGCGGCTTCGAACTTTGGTCCTGGGAAGTTAT<br>TTAAGGGTGCTAAAAGGGTTTATAGGTTTGTAAAATCTGG<br>TAAAAACTTCAATTGGAAACATATCAAAAAAGATCATGGA<br>CCTAAGTCAAAAGCCCGAATGCCAAATGGCCAACCGAAAA<br>GCAAGTTTAGAAGTGCTAAAACTCTTAGAAGAACAACAAA<br>GGCAACAGCTAGAACTAAACCTGCATACACTCAGAAAGAT<br>GGTAGGACAGTACATTATAAAAAGTTTAAAAAGCCTATAG<br>GAAGAAAAACGAATGGTCGGCATACTTATACTGTAAAGGT<br>TGTTAAGTCCGGAAGGTATGTTGTAACAAGCTATCCTTAT<br>TGA |
| SB3755 (SEQ ID NO: 16) | ATGGCCCGCTACTACGAGCCAAGAAACGGCGTATTCTTAT<br>CACTAGACCCAGACCCGGGCAGTGACGGCGATTCTTTAGA<br>TCAGAATGGATATGCATACGGAAACAACAACCCGGTGATG<br>AACGTCGATCCTGACGGGCATTGGGTGTGGATGGTAGCAG<br>GAGCTTTAATTGGCGGAATTTCATCTTATAAAGCAGCAAA<br>AGCAAAGGGGGCAAGAGGTTGGAGGTTAGTTGGATCTGTA<br>GCCTTAGGTGCTGCTGGCGGAGCAATCGGGGGAAACTATC<br>TACGAGTAGGACGTACTCTATATAAGGCTGGAAAATTATC<br>TAAAACGTATTGGAACGCTAGAAAAGTTGCAAAAGCAAAC<br>AAAGGTGTAATTAAAAGAGCTAGAAATAAGAAAGGTTGGG<br>TAGTTACTACTAAAAAACATACAGTAAGATTAATGGGAAG<br>GAATTCAGGACAAAGGAAAAGACCTTATTATCGAATGAGT<br>CATCATAAAAAAGGGGCCATGAACGCAAAGGGACACTATT<br>CAAATAAACAAGCTGAGACTCATATTAAATTAAGATGGCA<br>TTCATATAGAAATATCAATAAAAGATTACGTAAGGGGAGA<br>TAA |
| UCMB5036 (SEQ ID NO: 17) | GACGAAGTAAATGACAACCGCTACCGCTACGCAGGCTACC<br>AATACGACGAAGAAACCGGCCTGTACTATCTCATGGCCCG<br>CTACTATGAGCCAAGAAACGGCGTATTCTTATCACTCGAT<br>CCAGACCCGGGAAGTGACGGCGATTCATTGGATCAGAATG<br>GATATACTTATGCCAATAACAATCCGGTGATGAAGGTCGA<br>CCCAGATGGGCACTGGGCCAGAATTCTATGGGAAGTAATA<br>AAAAAGGTCATGGAATGGTGCTCCAGGAAAGTGGGCAAAGA<br>GGAATGTTGGTAAGGCATATAATGCATCAAAGAAATGGAC<br>TAAATCAGTTATTAAAAAAGGCGCAAAAAAAATCGCGAAA<br>AGGATTCCATATAGAATTCATAAAGTAGGCCGTATAAAAG<br>GGGATAGAGAAAAGGAAGAGGTTATTGGGGAATAATCTA<br>TTCGAGAAAGAAAAAGACTGGGAGGTCTATATATAGATCT<br>CTAGAGTGGCATACACCCACATAATAATCATGTTATCATT<br>TACAAAGTAATAAGTTTTCTATATATAAAGGGAAATGAA |

TABLE 1 -continued wapA sequences from *Bacillus amyloliquefaciens* subsp. *plantarum* that encode the 200 C-terminal amino acids of WapA

| Strain(s) from which sequence originated | Nucleotide sequence |
|---|---|
| | AAGGGGCAGTGCACAATGGCGGTTTACAGTGTATAAAGA<br>TAG |
| Y2 (SEQ ID NO: 18) | GACGAAGTAAAAGACAACCGCTACCGCTACGCAGGCTACC<br>AATACGACGAAGAAACCGGCCTGTACTATCTCATGGCCCG<br>CTACTACGAGCCAAGAAACGGCGTATTCTTATCACTAGAC<br>CCAGACCCGGGCAGTGATGGGGATTCTTTAGATCAGAATG<br>GGTATACTTATGCCAATAACAATCCGGTGATGAAGGTCGA<br>CCCAGATGGGCATTGGGCCAGAATTCTATGGGAAGTAATA<br>AAAAGGTCATGGAATGGTGCTCCAGGAAAGTGGGCAAAGA<br>GGAATGTTGGTAAGGCATATAATGCATCAAAGAAATGGAC<br>TAAATCAGTTATTAAAAAAGGCGCAAAAAAAATCGCGAAA<br>AGGATTCCATATAGAATTCATAAAGTAGGCCGTATAAAAG<br>GGGATAGAGAAAAAGGAAGAGGTTATTGGGGAATAATCTA<br>TTCGAGAAAGAAAAAGACTGGGAGGTCTATATATAGATCT<br>CTAGAGTGGCATACACCCACATAATAATCATGGTTATCATT<br>TACAAAGTAATAAGTTTTCTATATATAAAGGGAAATGGAA<br>AAGGGGCAGTGCACAATGGCGGTTTACAGTGTATAAAGA<br>TAG |
| TJ1000SD, TJ1000VA (SEQ ID NO: 19) | TTCTTATCACTAGACCCAGACCCGGGCAGCGACGGCGATT<br>CTTTAGATCAGAATGGATATGCATACGGAAACAACAACCC<br>AGTCATGAACGTCGATCCTGACGGGCATTGGGTGTGGCTT<br>GTGGTAAATGCCGGATTTGCAGCCTATGATGGATATAAGG<br>CATATAAATCAGGTAAAGGATGGAGAGGTGCAGCCTGGGC<br>AGCCGCTTCGAACTTTGGTCCTGGGAAGTTATTTAAGGGT<br>GCTAGTCGGGTTTATAAAGCGGTTAAAAGTTACAAATTTG<br>TTCGAAAAGCAAAAGGTGGTACGTATAAGGGAAGGCTTAA<br>AAGTAAATATTCAAAGAAGCGTTTTGTACCCGATAGTTAT<br>TGGAGTAGAAAAGCTTCCCATTTTGGTACACCGAATAGCC<br>GTATTACCCATTATAGATTATATAAAGGCAGGAAGGAGAG<br>ATCGACTGTAATATATGATAAATATGGGCGTCAAAAGTAT<br>CGCATAGATCACTCGAATCATGGTATGCCTAGAGCGCATT<br>CTAAACCACACCTTCACGAATATCATTTTGGAAGAGGTTA<br>TGGGCCAAAAGGAAAAAATAAAACTCATAATTTTTGGAGA<br>TGA |

From the analysis of the *Bacillus amyloliquefaciens* genome regions encoding WapA proteins, these regions appeared syntenic with the WapA-encoding genome regions of *Bacillus subtilis*. In *Bacillus subtilis*, wapI genes are co-linear with, and downstream of wapA (Koskiniemi, et al., 2013, Rhs proteins from diverse bacteria mediate intercellular competition, *Proc. Natl. Acad. Sci. USA* 110:7032-7037). Putative *Bacillus amyloliquefaciens* WapI-encoding regions were assigned based on their location downstream (3') of WapA-encoding regions (Example 3). The *Bacillus amyloliquefaciens* WapI amino acid sequences are shown in Table 2. The nucleotide sequences encoding these amino acid sequences are shown in Table 3.

TABLE 2

WapI sequences from *Bacillus amyloliquefaciens* subsp. *plantarum*

| Strain from which sequence(s) originated | Amino acid sequence | Wap Group |
|---|---|---|
| SB3296, SB3760, AS43.3, SB3233, SB3282 (SEQ ID NO: 20) | MNHYFIDHPKELKVYQSIINSLFHVEQTLPKQVFKQ<br>RKNYYLFEEFHWVLSEESWGMFKSLANEHHDEFILM<br>AVIDSSEDTNQFYEEFEYFNWIKIPLHITADEYLSI<br>LTDYPKHSKSDCIMNIASRVVWASPTLKWAIYGERE<br>LEICILGIDHQSEGKELATWRSLDDVVLDWISVVFP<br>NQTVPVEFEKTLTAHYK | 1 |
| BS1b (SEQ ID NO: 21) | MNHYFIDHPKELKVYQSIINSLCHVDQTLPKQVFKQ<br>RKNYYLFEEFHWVLSEESWGMFKSLANEHHDEFILM<br>AVIDSSEHINQFYEEFEYFNWIKIPLHITADEYLSL<br>LTDYPKHSKSDCIMNIASRVVWASPTLKWAIYGERE<br>LEICILGIDHQSEGKELATWRSLDGVVLDWISVVFP<br>NQTVPVEFEKTLMAHYK | 1 |
| M27 (SEQ ID NO: 22) | MNHYFIDHPKELKVYQSIINSLCHVDQTLPKQVFKQ<br>RKNYYLFEEFHWVLSEESWGMFKSLANEHHDEFILM<br>AVIDSSEHINQFYEEFEYFNWIKIPLHITADEYLSL<br>LTDYPKHSKSDCIMNIASRVVWASPTLKWAIYGERE | 1 |

TABLE 2 -continued

WapI sequences from *Bacillus amyloliquefaciens* subsp. *plantarum*

| Strain from which sequence(s) originated | Amino acid sequence | Wap Group |
|---|---|---|
| | LEICILGIDHQSEGKELATWRSLDGVVLDWISVVFP NQTVPVEFEKTLMAHYK | |
| SB3199, SB3756, QST713 (SEQ ID NO: 23) | MLGGKKEAILALLNDSFNKEEFPFLDNENFDFAKGK LSIFIERDNWLLTFQLFGLSRLGPAIDFYAVGNQLT NNEVSFLDDEPFLFADEKGNLLELEDIESGFTSKQI NVSLREKTFQFFIEQEIKDKISPKNEWITCLRHMTK NRLFLDTLWLTKQEQLEIAGLSSEYEQLYSTELWMH PEGEKDLPSLSPFFQSIAEAISRQEIAYIQKHDDGN TEWPKWAHTDSVQYF | 2 |
| UCMB5033, SB3276 (SEQ ID NO: 24) | MGYWEEEYKNKKVLLSDEGLDICFDAVEKFCERYKR DLGREPILEEFLATLVTVMNINGDSSFTELVDKRIV EIKATTRKAKSIAKVVPGAVIQIPLDKIGKYTYAWV IEGDLSKNKDDDILIQYYNIFTENTLSREEVIRLMK EENKKIFAANTGHTGFLQGDWKVISKMPQEMIEKNS HSQLKFVLYEDGKYLVSEGDSFASEDELAEADEKTG KDIPNPLGIFGHSSVESILYKYFEGMTMEEIIKNEL | 3 |
| TrigoCor (SEQ ID NO: 25) | MGYWEEEYKNKKVLLSDEGLDICFDAVEKFCELYKR ELDREPILEEFLATLVTVMNINGDSSFTELVDKRIV EIKPTTRKVKPIAKVTPGAVIQIPLDKIGKYTYAWV IEGDLSKNKDDDILIQYYNIFTENTLSREEIIRLMK EENKKIFAANTGHTGFLQGDWKVISKMPQEIIEKNS HSQLKFVLYEDGKYLVSEGDSFASEDELAEADEITG KDIPNPLGIFGHSSVESILYKYFEGMTMEEIIKNEL | 3 |
| GB03 (SEQ ID NO: 26) | MRRKLDEKLKENKRKILIKQLKERLQYCEKKGFVYQ LADVEQSRNLLEAVLSNSIEGMLREVKVNNKKEAEQ LLKETTACLGSESKNNIIYLFHPHSDEVGAIKSTLK DCVEHLGCLLDFIEFEGQLLSNSFILLEPSFAFAIC LFHTEYGCELFYAKKQ | 4 |
| SB3190, SB3195, SB3200 (SEQ ID NO: 27) | MRRKLDEKLKENKRKILIKQLKERLQYCEKKGFVYQ LADVEQSRDLLEAVLSNSIEGMLREVKVNNKKEAEQ LLKETTASLGSESKNNIIYLFHPHSDEVGAIKSTLK DCVEHLGCLLDFIEFEGQLLSNSFILLEPSFAFAIC LFHTEYGCELFYAKKQ | 4 |
| CAU B946 (SEQ ID NO: 28) | MLELTAKRVGSYKREHIIYFNTGRDDQVFIVSVHDH KVILEVMKGSSLLIKKELHGFSEDAHFYLVDSYDDT IVIVYLENHTCQLAVYCVNSNKINPICSFLLSANVF HLGEDGLLWIGLTDEGMYDERNPQGKAIFAFHAEDR TFYFKDDFKEMMHECYAIQSIKSDLYVCFEGEDCCV IGHYQIGRDRIRTVAEYVLNGDQYSYCDQLSVSKNR VLLIQNHEDNLFAFHEESKGLSEADVMIHGIDRKGK TTYRAVQDRMFIFHDNDLYLVKF | 5 |
| SB3281 (SEQ ID NO: 29) | MLELTAERVGSYERENIIYFNAGRDDQVFIVSVHDH KVILEVMKGSSLLIKKELHGFSEDAHFYLVDSYDDT IVIVYLENHTCQLAVYCVNSNKINPICSFLLSANVF HLGEDGLLWIGLTDEGMYDERNPQGKAIFAFHAEDR TFYFKDDFKEMMHECYAIQSIKSDLYVCFEGEDCCV IGHYQIGRDRIRTVAEYVLNGDQYSYCDQLSVSKKR VLLIQSHDDTLFAFHEEHKETDVMIHGIDRKGETTY RAVQDRMFIFSDNDLYLVKY | 5 |
| SB3297 (SEQ ID NO: 30) | MDELKFRDLNVKVNEEDSVLLTLTESEIIVLTKKEI DYGNKYINQIDLYCNTNGQFLNSFSIQTNEQVINVQ KVSDTFLLLIDKEYEDGVRNVDPNIYLWSPLKGFYQ SFYAGRYVNSMIIDQNKNLWVGYDEAGIFSCVDSEL STKGINKFVFKNGLYELCARDVNPYIVDQYYSTFVD KDAIYLYYRSMSENYLQKLNFLGETLERIEIEIECA SCVISETSSYFFIRDEDSYNIEIALKTNNMQSYTKQ IIMDENTAESISFTHVASYKDKCAGIDINNNLFLLS SF | 6 |
| SB3755 (SEQ ID NO: 31) | MYKTINEWVDYIDGGCAVLHFDFQVFKKELSLKIQV VENKAEYTHNILFQNVASVYFSADIGDMRLEKIDPE EYNWQVFEMSYHPEGIGNLSNAVIPEYQSNANFLID MNRMLIAIEAETVRFDDQSFYAYHSKS | 7 |
| UCMB5036 (SEQ ID NO: 32) | MYYFYEISTLNDYDWVEKEYKTIEDLIFVILKNMEN KQYAMYSYSVSNKDSDTCIFSASLKTNTLFNKKISF IKTSAEEYKNTIIAHENIILLEKDVELKDILNGAPL | 8 |

TABLE 2 -continued

Wap1 sequences from *Bacillus amyloliquefaciens* subsp. *plantarum*

| Strain from which sequence(s) originated | Amino acid sequence | Wap Group |
|---|---|---|
| | AEKTIIKDLLDYVLYHIEITDSETIRIGSRHRENII NIIK | |
| Y2 (SEQ ID NO: 33) | MYYFYEISTLNDYDWVEKEYKTIEDLIFVILKNMEN KQYAMYSYSLSNKDSDTCIFSASLKTNTLFNKKISF MKTSAEEYKNTIVAHENIILLEKDVELKDILNGAPL AEKTIIKDLLDYVLYHIEITDSETIRIGSSYRENII NIIK | 8 |
| TJ1000SD, TJ1000VA (SEQ ID NO: 34) | MDWYLDEKIEKKIKDFQITNLKQVTNFNYYREYNDF YDVISSIELTLLYEYLKEEYQIKLKFENVSSVELTN LDYGHQDSYLSINIERINNSWEKIKYIVEDYEEQSF RFYCENYKVIGVENTNN | 9 |

TABLE 3 wap1 sequences from *Bacillus amyloliquefaciens* subsp. *plantarum*

| Strain from which sequence originated | Nucleotide sequence |
|---|---|
| SB3296, SB3760, AS43.3, SB3233, SB3282 (SEQ ID NO: 35) | ATGAATCACTATTTTATTGATCATCCTAAGGAGTTAAAAGTCT ATCAATCCATAATTAATTCCTTATTTCACGTAGAGCAAACATT GCCTAAACAAGTTTTTAAACAAGGAAAAATTATTATTTATTC GAGGAATTCCATTGGGTATTATCTGAAGAAAGTTGGGGAATGT TTAAGAGTTTGGCTAATGAGCATCATGATGAGTTTATATTAAT GGCTGTTATAGATAGTTCTGAAGATACAAACCAATTTTACGAA GAATTTGAGTATTTTAACTGGATAAAGATCCCTTTGCATATAA CTGCAGATGAGTATCTGTCAATCTTAACTGATTATCCAAAGCA CAGTAAAAGTGACTGTATAATGAATATTGCATCTCGTGTTGTT TGGGCTTCACCGACTTTAAAGTGGGCGATTTATGGTGAGAGAG AACTTGAAATCTGTATTCTAGGTATTGATCATCAGAGTGAAGG AAAAGAACTAGCAACTTGGAGATCGTTAGATGACGTTGTCTTA GATTGGATATCAGTTGTATTCCCAAACCAGACGGTTCCAGTTG AATTTGAAAAAACACTTACGGCACATTACAAATAA |
| BS1b (SEQ ID NO: 36) | ATGAATCACTATTTTATTGATCATCCTAAGGAGTTAAAAGTCT ATCAATCCATAATTAATTCCTTATGTCACGTAGATCAAACATT GCCTAAACAAGTTTTTAAGCAAAGGAAAAATTATTATTTATTC GAGGAATTCCATTGGGTATTATCTGAAGAAAGTTGGGGAATGT TTAAGAGTTTGGCTAATGAACATCATGATGAGTTTATATTAAT GGCTGTTATAGACAGTTCTGAACATATAAACCAATTCTACGAA GAATTTGAGTATTTTAACTGGATAAAGATCCCTTTGCATATAA CTGCAGATGAGTATCTGTCACTCTTAACTGATTATCCAAAGCA CAGTAAAAGTGACTGTATAATGAATATTGCATCTCGTGTTGTT TGGGCTTCACCGACTTTAAAGTGGGCGATTTATGGTGAGAGAG AACTTGAAATTTGTATTCTAGGTATTGATCATCAGAGTGAAGG AAAAGAACTAGCAACTTGGAGATCGTTAGATGGCGTTGTCTTA GATTGGATATCAGTTGTATTCCCAAATCAGACGGTTCCAGTTG AATTTGAAAAAACACTTATGGCACATTACAAATAA |
| M27 (SEQ ID NO: 37) | ATGAATCACTATTTTATTGATCATCCTAAGGAGTTAAAAGTCT ATCAATCCATAATTAATTCCTTATGTCACGTAGATCAAACATT GCCTAAACAAGTTTTTAAGCAAAGGAAAAATTATTATTTATTC GAGGAATTCCATTGGGTATTATCTGAAGAAAGTTGGGGAATGT TTAAGAGTTTGGCTAATGAACATCATGATGAGTTTATATTAAT GGCTGTTATAGACAGTTCTGAACATATAAACCAATTCTACGAA GAATTTGAGTATTTTAACTGGATAAAGATCCCTTTGCATATAA CTGCAGATGAGTATCTGTCACTCTTAACTGATTATCCAAAGCA CAGTAAAAGTGACTGTATAATGAATATTGCATCTCGTGTTGTT TGGGCTTCACCGACTTTAAAGTGGGCGATTTATGGTGAGAGAG AACTTGAAATCTGTATTCTAGGTATTGATCATCAGAGTGAAGG AAAAGAACTAGCAACTTGGAGATCGTTAGATGGCGTTGTCTTA GATTGGATATCAGTTGTATTCCCAAATCAGACGGTTCCAGTTG AATTTGAAAAAACACTTATGGCACATTACAAATAA |
| SB3199, SB3756, QST713 (SEQ ID NO: 38) | ATGTTGGGTGGAAAAAAAGAAGCCATTCTCGCATTGCTTAACG ATTCATTCAATAAGGAAGAGTTTCCGTTTCTTGATAATGAGAA TTTTGACTTCGCAAAAGGGAAGCTTTCGATTTTTATTGAAAGA GATAACTGGCTTTTAACGTTCCAGCTGTTTGGATTGTCGAGAT TGGGACCAGCTATTGATTTTTATGCGGTGGGTAATCAATTAAC AAATAATGAAGTAAGTTTTTTAGATGATGAACCGTTTTTATTT |

TABLE 3 -continued wapI sequences from *Bacillus amyloliquefaciens* subsp. *plantarum*

| Strain from which sequence originated | Nucleotide sequence |
| --- | --- |
| | GCAGATGAAAAAGGAAATTTGCTGGAATTGGAAGATATAGAAT CGGGTTTTACAAGTAAACAAATCAATGTGTCTCTTAGAGAGAA AACATTTCAATTTTTTATTGAGCAGGAAATAAAAGATAAGATT TCCCCAAAGAATGAATGGATTACATGTTTGAGGCATATGACCA AAAATAGATTATTTCTTGACACACTTTGGCTGACGAAACAAGA ACAACTGGAAATAGCGGGTCTCTCTTCGGAGTATGAACAATTG TATTCAACAGAATTATGGATGCATCCAGAAGGAGAAAAAGATT TGCCTAGTTTGTCTCCTTTCTTTCAATCAATTGCCGAAGCAAT TTCCCGTCAAGAGATAGCATATATTCAAAAACATGATGATGGT AACACAGAGTGGCCAAAATGGGCACACACAGATTCTGTTCAAT ACTTTTGA |
| UCMB5033, SB3276 (SEQ ID NO: 39) | TTGGGATATTGGGAAGAAGAATATAAAAACAAGAAAGTTTTAC TTAGTGATGAAGGCTTAGATATATGTTTTGATGCTGTAGAAAA ATTTTGTGAACGATATAAGAGAGATCTGGGCAGAGAACCGATA TTAGAAGAATTCTTAGCAACTTTAGTTACCGTAATGAATACAA ATGGAGATTCTTCTTTCACGGAGTTAGTTGATAAGCGAATAGT AGAAATAAAGGCAACAACCAGGAAAGCGAAATCAATAGCTAAA GTAGTACCGGGAGCTGTTATTCAAATACCTTTGGATAAGATCG GGAAGTATACTTATGCTTGGGTCATTGAAGGTGATCTATCAAA AAACAAAGACGATGACATTCTTATTCAGTATTATAATATTTTC ACTGAAAATACACTTAGCAGAGAAGAAGTCATTCGTCTAATGA AAGAAGAAAATAAGAAAATATTTGCGGCTAATACTGGGCACAC AGGTTTTCTGCAAGGAGATTGGAAAGTAATTTCCAAGATGCCT CAAGAGATGATAGAGAAAAACAGTCATTCTCAATTAAAATTTG TTTTATATGAAGACGGTAAATATCTCGTGAGTGAAGGCGATTC ATTTGCATCAGAAGATGAATTAGCAGAGGCAGATGAGAAAACA GGCAAGGACATCCCAAACCCATTAGGTATATTTGGACATTCAT CTGTAGAATCTATTCTCTATAAATATTTTGAAGGGATGACAAT GGAGGAAATCATAAAGAATGAATTGTAA |
| TrigoCor (SEQ ID NO: 40) | TTGGGATATTGGGAAGAAGAATATAAAAACAAGAAAGTTTTAC TTAGTGATGAAGGCTTAGATATATGTTTTGATGCTGTAGAGAA ATTTTGTGAATTATATAAGAGGGAGCTGGATAGAGAACCGATA TTAGAAGAATTCTTAGCAACTTTAGTTACCGTAATGAATACAA ATGGAGATTCTTCTTTCACAGAGTTAGTTGATAAGCGAATAGT AGAAATAAAGCCAACGACCAGGAAAGTGAAACCAATAGCTAAA GTAACACCGGGAGCTGTTATTCAAATACCTTTGGATAAGATCG GGAAGTATACTTATGCTTGGGTCATTGAAGGTGATCTATCAAA AAATAAAGACGATGACATTCTTATTCAGTATTATAATATTTTC ACTGAAAATACACTTAGCAGAGAAGAAATCATTCGTCTAATGA AAGAAGAAAATAAGAAAATATTTGCGGCTAATACCGGGCACAC AGGTTTTCTGCAAGGAGATTGGAAAGTAATATCCAAGATGCCT CAAGAGATAATAGAGAAAAACAGTCATTCTCAATTAAAATTTG TTTTATATGAAGACGGTAAATATCTCGTGAGTGAAGGCGATTC ATTTGCATCAGAAGATGAATTAGCAGAGGCAGATGAGATAACA GGCAAGGACATCCCTAACCCATTGGGTATATTTGGACATTCAT CTGTAGAATCTATTCTATATAAATATTTTGAAGGGATGACAAT GGAGGAAATCATAAAGAATGAATTGTAA |
| GB03 (SEQ ID NO: 41) | TTGAGAAGAAAATTAGATGAAAAACTTAAGGAGAATAAGAGGA AAATTTTAATAAAACAATTAAAAGAGAGATTACAATACTGCGA AAAAAAGGGGTTTGTTTACCAACTTGCCGATGTAGAGCAAAGC CGCAATTTGTTGGAGGCTGTGTTATCAAATTCTATCGAAGGTA TGTTGCGTGAAGTGAAGGTGAATAACAAAAAGGAGGCTGAACA GTTATTAAAAGAAACCACCGCCTGCTTGGGTTCTGAGAGCAAA AATAATATTATCTACCTATTTCATCCACATAGTGATGAAGTGG GAGCCATCAAGAGTACTCTGAAAGATTGTGTAGAGCATCTAGG CTGTTTATTAGATTTTATTGAATTTGAAGGTCAATTACTTTCT AATAGCTTTATTTTGCTAGAACCATCCTTTGCATTTGCAATCT GTTTATTTCACACAGAATATGGTTGTGAGCTCTTTTATGCAAA AAAACAGTAA |
| SB3190, SB3195, SB3200 (SEQ ID NO: 42) | TTGAGAAGAAAATTAGATGAAAAACTTAAGGAGAATAAGAGGA AAATTTTAATAAACAATTAAAAGAGAGATTACAATACTGCGA AAAAAAGGGGTTTGTTTACCAACTTGCCGATGTAGAGCAAAGC CGCGATTTGTTGGAGGCTGTGTTATCAAATTCTATCGAAGGTA TGTTGCGTGAAGTGAAGGTGAATAACAAAAAGGAGGCTGAACA GTTATTAAAAGAAACCACCGCCAGCTTGGGTTCTGAGAGCAAA AATAATATTATCTACCTATTTCATCCACATAGTGATGAAGTGG GAGCCATCAAGAGTACTCTGAAAGATTGTGTAGAGCATCTAGG CTGTTTATTAGATTTTATTGAATTTGAAGGTCAATTACTTTCT AATAGCTTTATTTTGCTAGAACCATCCTTTGCATTTGCAATCT GTTTATTTCACACAGAATATGGTTGTGAGCTCTTTTATGCAAA AAAACAGTAA |

TABLE 3 -continued wapI sequences from *Bacillus amyloliquefaciens* subsp. *plantarum*

| Strain from which sequence originated | Nucleotide sequence |
|---|---|
| CAU B946 (SEQ ID NO: 43) | ATGTTAGAACTTACCGCGAAGCGGGTTGGGTCATATAAAGAG<br>AGCACATCATTTATTTCAATACGGGTCGGGATGATCAAGTATT<br>TATTGTGTCGGTGCATGATCACAAAGTAATATTGGAGGTTATG<br>AAAGGCAGCTCTCTTTTAATCAAAAAAGAGTTACACGGATTTT<br>CTGAAGATGCCCATTTCTATCTGGTTGATTCGTATGATGACAC<br>TATCGTGATCGTTTACCTGGAAAATCATACGTGTCAATTAGCT<br>GTATACTGCGTAAACAGTAATAAAATCAATCCGATTTGTTCTT<br>TTCTATTAAGCGCCAATGTATTTCATCTGGGTGAGGATGGATT<br>ACTATGGATCGGATTAACAGACGAGGGTATGTATGATGAGAGA<br>AACCCTCAAGGGAAAGCGATATTTGCTTTTCATGCAGAAGACA<br>GAACGTTTTATTTTAAAGACGATTTTAAAGAAATGATGCACGA<br>ATGCTATGCCATACAATCGATCAAATCTGATTTGTATGTATGT<br>TTTGAGGGAGAGGATTGCTGTGTCATCGGTCATTATCAGATTG<br>GACGGGACAGAATTCGTACTGTTGCAGAATATGTGCTAAACGG<br>CGATCAATACTCCTATTGTGACCAGCTGTCCGTTTCGAAAAAT<br>AGGGTGCTGCTGATACAGAATCACGAGGATAACCTATTTGCAT<br>TTCATGAAGAGAGCAAAGGGTTATCAGAGGCTGACGTCATGAT<br>ACACGGTATTGATAGAAAAGGAAAAACAACGTACAGAGCCGTC<br>CAGGACCGCATGTTTATCTTTCATGATAACGATTTATATCTGG<br>TAAAGTTTTGA |
| SB3281 (SEQ ID NO: 44) | ATGTTAGAACTTACCGCGGAGCGTGTTGGGTCATATGAAAGGG<br>AAAATATCATTTATTTCAATGCGGGTCGGGATGATCAAGTATT<br>TATTGTGTCGGTGCATGATCACAAAGTAATATTGGAGGTTATG<br>AAAGGCAGCTCTCTTTTAATCAAAAAAGAGTTACACGGATTTT<br>CTGAAGATGCCCATTTCTATCTGGTTGATTCGTATGATGACAC<br>TATCGTGATCGTTTACCTGGAAAATCATACGTGTCAATTAGCT<br>GTATACTGCGTAAACAGTAATAAAATCAATCCGATTTGTTCTT<br>TTCTATTAAGCGCCAATGTATTTCATCTGGGTGAGGATGGATT<br>ACTATGGATCGGATTAACAGACGAGGGTATGTATGATGAGAGA<br>AACCCTCAAGGGAAAGCGATATTTGCTTTTCATGCAGAAGACA<br>GAACGTTTTATTTTAAAGACGATTTTAAAGAAATGATGCACGA<br>ATGCTACGCCATACAATCGATCAAATCTGATTTGTATGTATGT<br>TTTGAGGGAGAGGATTGCTGTGTCATCGGTCATTATCAGATTG<br>GACGGGACAGAATTCGTACTGTTGCAGAATATGTGCTAAACGG<br>CGATCAATACTCCTATTGTGATCAGCTATCCGTTTCGAAAAAA<br>AGGGTGCTGCTGATTCAGAGTCACGATGATACCCTATTTGCAT<br>TTCATGAAGAGCACAAAGAGACTGACGTCATGATACACGGTAT<br>TGATAGAAAAGGAGAAACAACGTACAGAGCCGTACAGGATCGC<br>ATGTTTATCTTTAGTGATAACGATTTATATCTGGTGAAGTATT<br>GA |
| SB3297 (SEQ ID NO: 45) | ATGGATGAATTAAAATTTAGAGATTTGAATGTAAAAGTAAATG<br>AGGAAGACTCAGTTCTGCTAACGTTGACTGAATCAGAAATAAT<br>TGTCCTAACAAAAAAAGAAATTGATTATGGCAACAAATATATT<br>AATCAAATTGATCTGTATTGTAATACGAATGGACAATTCCTGA<br>ATAGCTTTAGCATACAAACAAATGAACAAGTTATAAACGTGCA<br>AAAAGTTAGCGATACTTTTTTACTTTTAATAGATAAAGAGTAC<br>GAGGACGGAGTTCGAAATGTTGATCCCAACATATATTTGTGGA<br>GTCCACTTAAAGGTTTCTACCAATCTTTTTATGCTGGAAGATA<br>CGTTAATTCAATGATAATAGATCAAAATAAGAATCTATGGGTC<br>GGATATGATGAAGCGGGCATATTTTCTTGCGTTGATTCCGAAT<br>TAAGCACGAAAGGAATTAATAAATTCGTTTTTAAAAATGGACT<br>ATATGAATTATGTGCTCGTGACGTTAATCCATATATTGTTGAC<br>CAGTACTATTCTACATTTGTAGATAAAGATGCAATCTATTTGT<br>ATTACAGATCAATGAGTGAAAATTACTTGCAAAAATTAAACTT<br>TCTTGGAGAAACATTGGAACGAATTGAGATTGAAATAGAGTGT<br>GCTTCATGCGTAATATCCGAAACATCTAGTTATTTTTTCATTC<br>GTGATGAGGATTCTTATAATATTGAGATAGCTCTGAAGACAAA<br>TAATATGCAAAGCTATACAAAACAAATAATAATGGATGAGAAT<br>ACTGCAGAAAGTATCAGTTTTACACATGTAGCATCATATAAAG<br>ATAAATGTGCAGGGATTGATATTAACAACAACCTTTTTCTGTT<br>AAGTAGTTTCTGA |
| SB3755 (SEQ ID NO: 46) | ATGTACAAAACAATAAATGAATGGGTAGATTACATAGATGGGG<br>GGTGCGCTGTCCTTCATTTTGATTTTCAAGTGTTTAAAAAAGA<br>ACTTTCACTTAAGATTCAGGTCGTTGAAAATAAAGCCGAATAT<br>ACGCATAACATTCTTTTTCAAAATGTAGCATCTGTTTATTTTA<br>GTGCAGATATTGGTGATATGAGATTAGAAAAAATAGATCCTGA<br>AGAATACAATTGGCAAGTATTTGAGATGAGTTACCACCCGGAA<br>GGAATCGGTAATCTATCAAATGCTGTAATTCCGGAGTATCAAT<br>CAAATGCTAATTTTCTCATTGACATGAACAGAATGCTGATTGC<br>TATAGAAGCTGAAACAGTTCGCTTTGATGATCAATCATTTTAT<br>GCGTATCATTCGAAATCATAA |

TABLE 3 -continued wapI sequences from *Bacillus amyloliquefaciens* subsp. *plantarum*

| Strain from which sequence originated | Nucleotide sequence |
|---|---|
| UCMB5036 (SEQ ID NO: 47) | ATGTACTATTTTTATGAAATATCAACTCTCAATGACTATGATT<br>GGGTTGAAAAAGAGTATAAAACAATAGAGGATTTAATATTTGT<br>TATATTAAAAAATATGGAAAATAAACAATACGCAATGTATTCT<br>TACTCTGTTTCAAATAAAGATAGTGATACTTGTATATTCTCAG<br>CGAGCTTAAAAACAAATACTTTGTTTAATAAAAAAATCTCATT<br>TATAAAAACCTCAGCAGAAGAGTACAAGAATACAATAATTGCG<br>CATGAAAATATAATCTTATTGGAAAAAGATGTTGAGTTAAAAG<br>ATATATTAAATGGAGCCCCTTTAGCAGAGAAAACAATTATTAA<br>AGATTTACTGGATTATGTTCTTTATCATATAGAAATAACAGAT<br>TCCGAGACAATCAGAATAGGATCTAGACATAGAGAAAATATTA<br>TAAACATTATTATAA |
| Y2 (SEQ ID NO 48) | ATGTACTATTTTTATGAAATATCAACTCTCAATGACTATGATT<br>GGGTTGAAAAAGAGTATAAAACAATAGAGGATTTAATATTTGT<br>TATATTAAAAAATATGGAAAATAAACAATATGCAATGTATTCT<br>TACTCTCTTTCAAATAAAGATAGTGATACTTGTATATTCTCAG<br>CGAGCTTAAAAACAAATACTTTGTTTAATAAAAAAATCTCTTT<br>TATGAAAACCTCAGCAGAAGAGTACAAAAATACAATAGTTGCG<br>CATGAAAATATAATCTTATTGGAAAAAGATGTTGAGTTAAAAG<br>ATATATTAAATGGAGCTCCTTTAGCAGAGAAAACAATTATTAA<br>AGATTTACTGGATTATGTTCTTTATCATATAGAAATAACAGAT<br>TCCGAGACAATCAGAATAGGATCTAGTTATAGAGAAAATATTA<br>TAAACATTATTATAA |
| TJ1000SD, TJ1000VA (SEQ ID NO: 49) | ATGGATTGGTATTTAGATGAAAAAATAGAAAAGAAAATAAAGG<br>ATTTTCAAATAACTAACTTAAAACAAGTTACTAATTTTAATTA<br>TTATAGAGAATATAATGACTTTTATGACGTAATTAGTTCAATA<br>GAGTTAACTCTATTGTACGAATATTTAAAGGAAGAATATCAAA<br>TAAAGTTAAAATTTGAGAATGTATCATCTGTAGAGTTAACTAA<br>CTTGGATTATGGTCATCAAGATTCTTATTTAAGTATTAACATA<br>GAAAGAATTAACAATAGTTGGGAAAAAATAAAATATATAGTAG<br>AAGATTATGAAGAACAATCTTTTAGATTTTATTGTGAGAATTA<br>TAAAGTAATTGGTGTTGAAAATACGAATAATTAA |

Although the disclosed WapI-encoding regions were identified based on their location in the genomes with respect to wapA (Example 3), the WapI-encoding sequences may also be identified using query sequences, similar to the methods used to identify *Bacillus amyloliquefaciens* WapA sequences, described above.

Once it is determined that a *Bacillus amyloliquefaciens* strain contains wapA and or wapI genes in their genomes and/or encodes WapA and/or WapI proteins, sequences from different strains may be compared to determine their relative sequence identities. In order to compare two sequences, the sequences generally are aligned and sequence identity calculated. There are a variety of methods to align multiple sequences. The methods generally differ in how "gaps" between the sequences are handled. There are a variety of such methods. In one example, the ClustalW method was used (Thompson et al., 2002, Multiple sequence alignment using ClustalW and ClustalX, *Curr. Protoc. Bioinformatics* 2:2.3.1-2.3.22). The ClustalW algorithm used was incorporated into the MegAlign program of DNAStar® [version 7.2.1 (1), 410].

To compare relative sequence identities of WapA proteins, the 200 C-terminal amino acids of the full-length WapA amino acid sequences shown in Table 4 were used.

TABLE 4

WapA-CT sequences from *Bacillus amyloliquefaciens* subsp. *plantarum*

| Strain from which sequence originated | Amino acid sequence | Wap Group |
|---|---|---|
| SB3296, SB3760, A543.3, SB3282 (SEQ ID NO: 50) | MARYYEPRNGVFLSLDPDPGSDGDSLDQNGYAYGNNNPVM<br>NVDPDGHWVWLVVNAGFAAYDGYKAYKSGKGWRGAAWAAA<br>SNFGPGKIFKGASRIYKAAKTYKLSRKSVRARRAYSSYRD<br>ITGKTSRFKNYSTNVRRRTFEKNLRRQGWRKSVHHGGVIT<br>MTKNGNKYSLRKHAKSSPYPTAEYTPKGRKKFTHKIRMRH | 1 |
| SB3233 (SEQ ID NO: 51) | MARYYEPRNGVFLSLDPDPGSDGDSLDQNGYAYGNNNPVM<br>NVDPDGHWVWLVVNAGFAAYDGYKAYKSGKGWRGAAWAAA<br>SNFGPGKLFKGASRIYKAAKTYKLSRKSVRARRAYSSYRD<br>ITGKTSRFKNYSTNVRRRTFEKNLRRQGWRKSVHHGGVIT<br>MTKNGNKYSLRKHAKSSPYPTAEYTPKGRKKFTHKIRMRH | 1 |
| BS1b (SEQ ID NO: 52) | MARYYEPRNGVFLSLDPDPGSDGDSLDQNGYTYGNNNPVM<br>NVDPDGHWVWLVVNAGFAAYDGYKAYKSGKGWRGAAWAAA<br>SNFGPGKLFKGANRIYKAAKTYKLSRKSVRARRAYSSYRD | 1 |

TABLE 4 -continued

WapA-CT sequences from *Bacillus amyloliquefaciens* subsp. *plantarum*

| Strain from which sequence originated | Amino acid sequence | Wap Group |
|---|---|---|
| | ITGKTSRFKNYSTNVKRRTFEKNLRRQGWRKSVHHGGVIT MTKNGNKYSLRKHAKSSPYPTAEYTPKGRKKFTHKIRMRH | |
| M27 (SEQ ID NO: 53) | MARYYEPRNGVFLSLDPDPGSDGDSLDQNGYAYGNNNPVM NVDPDGHWVWLAINAGFAAYDGYKAYKSGKGWRGAAWAAA SNFGPGKLFKGANRIYKAAKTYKLSRKSVRARRAYSSYRD ITGKTSRFKNYSTNVKRRTFEKNLRRQGWRKSVHHGGVIT MTKNGNKYSLRKHAKSSPYPTAEYTPKGRKKFTHKIRMRH | 1 |
| SB3199, SB3756 (SEQ ID NO: 54) | RYYEPRNGVFLSLDPDPGSDGDSLDQNGYAYGNNNPVMNV DPDGHWVWLVVNAGFAAYDGYKAYKSGKGWRGAAWAAASN FGPGKVFKGAKKALGFAKAAKKYLKPGKYARRSIPARSTS SRLNKKERRVLNKIGNKYGCHTCGRRHPGTKSRNWIADHQ PVSKLRKKGQRQRLYPHCQTCSRKQGGYTSAILRKRHQRR | 2 |
| QST713 (SEQ ID NO: 55) | RYYEPRNGVFLSLDPDPGSDGDSLDQNGYAYGNNNPVMNV DPDGHWVWLVVNAGFAAYDGYKAYKSGKGWRGAAWAAASN FGPGKVFKGAKKALGFAKAAKKYLKPGKYARRSIPARSTS SRLNKKERRVLNKIGNKYGCHTCGRRHPGTKSRNWIADHQ PVSKLRKKGQRQRLYPHCQTCSRKQGGYTSAILRKRHQRR | 2 |
| UCMB5033, SB3276 (SEQ ID NO: 56) | DEETGLYYLMARYYEPRNGVFLSLDPDPGSDGDSLDQNGY AYGNNNPVMNVDPDGHWVWLVVNAGFAAYDGYKAYKSGKG WRGAAWAAASNFGPGKLFKGAKRVYKAVHSVYVLKKGKKV VYVGRSKNLKKRAAVHKKNHPDTRMVKKRGGLTYAQARGL EHRYYLKYGGKKKLRNKIRPISRKNKKYKYYMSSSRKFYK | 3 |
| TrigoCor (SEQ ID NO: 57) | DEETGLYYLMARYYEPRNGVFLSLDPDPGSDGDSLDQNGY AYGNNNPVMNVDPDGHWVWLVVNAGFAAYDGYKAYKSGKG WRGAAWAAASNFGPGKLFKGASRAYKAVHSVYVLKKGKKV VYVGRSKNLKKRAAVHKKNHPDTRMVKKRGGLTYAQARGL EHRYYLKYGGKKKLRNKIRPISRKNKKYKYYMSSSRRFYK | 3 |
| GB03, SB3190, SB3195, SB3200 (SEQ ID NO: 58) | YYEPRNGVFLSLDPDPGSDGDSLDQNGYAYGNNNPVMNVD PDGHWVWLVVNAGFAAYDGYKAYKSGKGWRGAAWAAASNF GPGKLFKGASRVYKATQQMSRRASFRAAKRAAGIPTSSQY KTHKKVYDGSSEHRTVYSFGRVGRGSHKKYVVLHKHDKRG RGPHFHGVGKGRSPLKKGRYNQLKGHYPEHFKGYRTKRRR | 4 |
| CAU B946 (SEQ ID NO: 59) | TGLYYLMARYYEPRNGVFLSLDPDPGSDGDSLDQNGYAYG NNNPVMNVDPDGHWVWLAINAGFAAYDGYKAYKSGKGWRG AAWAAASNFGPGKLFKGAKRVYKFASSSRKVKQIDWKHIK KGHSPKSKIPNKGKFKSNRAMKRTTRHTLKRGKARPGHSG ATVYEKKFKRYVGINSRGKKTKRVRVVVQPNGKLRTSFPY | 5 |
| SB3281 (SEQ ID NO: 60) | TGLYYLMARYYEPRNGVFLSLDPDPGSDGDSLDQNGYAYG NNNPVMNVDPDGHWVWLAINAGFAAYDGYKAYKSGKGWRG AAWAAASNFGPGKLFKGAKRVYKFASSSRKVKQIDWKHIK KGHAPKSKIPNKGKFKSNRAMKRTTRHTLKRGKARPGHSG ATVYEKKFKRYVGINSRGKKTKRVRVVVQPNGKLRTSFPY | 5 |
| SB3297 (SEQ ID NO: 61) | GLYYLMARYYEPRNGVFLSLDPDPGSDGDSLDQNGYAYGN NNPVMNVDPDGHWVWLVVNAGFAAYDGYKAYKSGKGWRGA AWAAASNFGPGKLFKGAKRVYRFVKSGKNFNWKHIKKDHG PKSKARMPNGQPKSKFRSAKTLRRTTKATARTKPAYTQKD GRTVHYKKFKKPIGRKTNGRHTYTVKVVKSGRYVVTSYPY | 6 |
| SB3755 (SEQ ID NO: 62) | MARYYEPRNGVFLSLDPDPGSDGDSLDQNGYAYGNNNPVM NVDPDGHWVWMVAGALIGGISSYKAAKAKGARGWRLVGSV ALGAAGGAIGGNYLRVGRTLYKAGKLSKTYWNARKVAKAN KGVIKRARNKKGWVVTTKKHTVRLMGRNSGQRKRPYYRMS HHKKGAMNAKGHYSNKQAETHIKLRWHSYRNINKRLRKGR | 7 |
| UCMB5036 (SEQ ID NO: 63) | DEVNDNRYRYAGYQYDEETGLYYLMARYYEPRNGVFLSLD PDGPGSDGDSLDQNGYTYANNNPVMKVDPDGHWARILWEVI KRSWNGAPGKWAKRNVGKAYNASKKWTKSVIKKGAKKIAK RIPYRIHKVGRIKGDREKGRGYWGIIYSRKKKTGRSIYRS LEWHTPHNNHGYHLQSNKFSIYKGKWKRGSAQWRFTVYKR | 8 |
| Y2 (SEQ ID NO: 64) | DEVKDNRYRYAGYQYDEETGLYYLMARYYEPRNGVFLSLD PDGPGSDGDSLDQNGYTYANNNPVMKVDPDGHWARILWEVI KRSWNGAPGKWAKRNVGKAYNASKKWTKSVIKKGAKKIAK RIPYRIHKVGRIKGDREKGRGYWGIIYSRKKKTGRSIYRS LEWHTPHNNHGYHLQSNKFSIYKGKWKRGSAQWRFTVYKR | |

TABLE 4 -continued

WapA-CT sequences from *Bacillus amyloliquefaciens* subsp. *plantarum*

| Strain from which sequence originated | Amino acid sequence | Wap Group |
|---|---|---|
| TJ1000SD, TJ1000VA (SEQ ID NO: 65) | FLSLDPDPGSDGDSLDQNGYAYGNNNPVMNVDPDGHWVWL VVNAGFAAYDGYKAYKSGKGWRGAAWAAASNFGPGKLFKG ASRVYKAVKSYKFVRKAKGGTYKGRLKSKYSKKRFVPDSY WSRKASHFGTPNSRITHYRLYKGRKERSTVIYDKYGRQKY RIDHSNHGMPRAHSKPHLHEYHFGRGYGPKGKNKTHNFWR | 9 |

Figure 1:
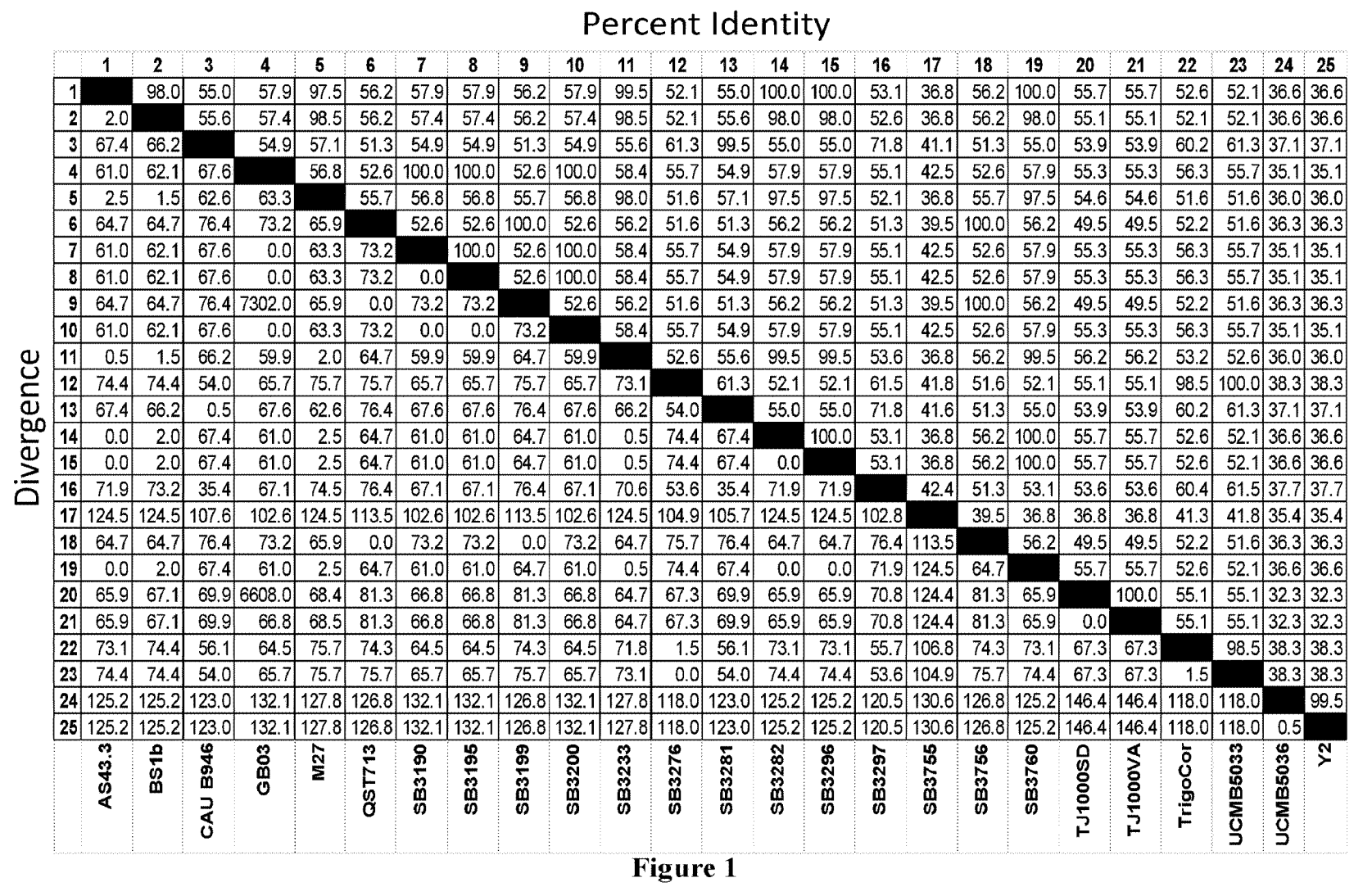

Pair-wise amino acid identity comparisons of the *Bacillus amyloliquefaciens* WapA-CT sequences, the sequences shown in Table 4, were determined as described in Example 2. Pair-wise sequence identities for the sequences are shown in FIG. 1. WapA-CT sequences with significant identity to one another were grouped or classified into the same "Wap Group." WapA-CT sequences that lacked significant identity with other WapA-CT sequences were classified into their own Wap Group. The sequence comparisons and results of classifying WapA-CT and are shown in FIG. 2.

Figure 3:
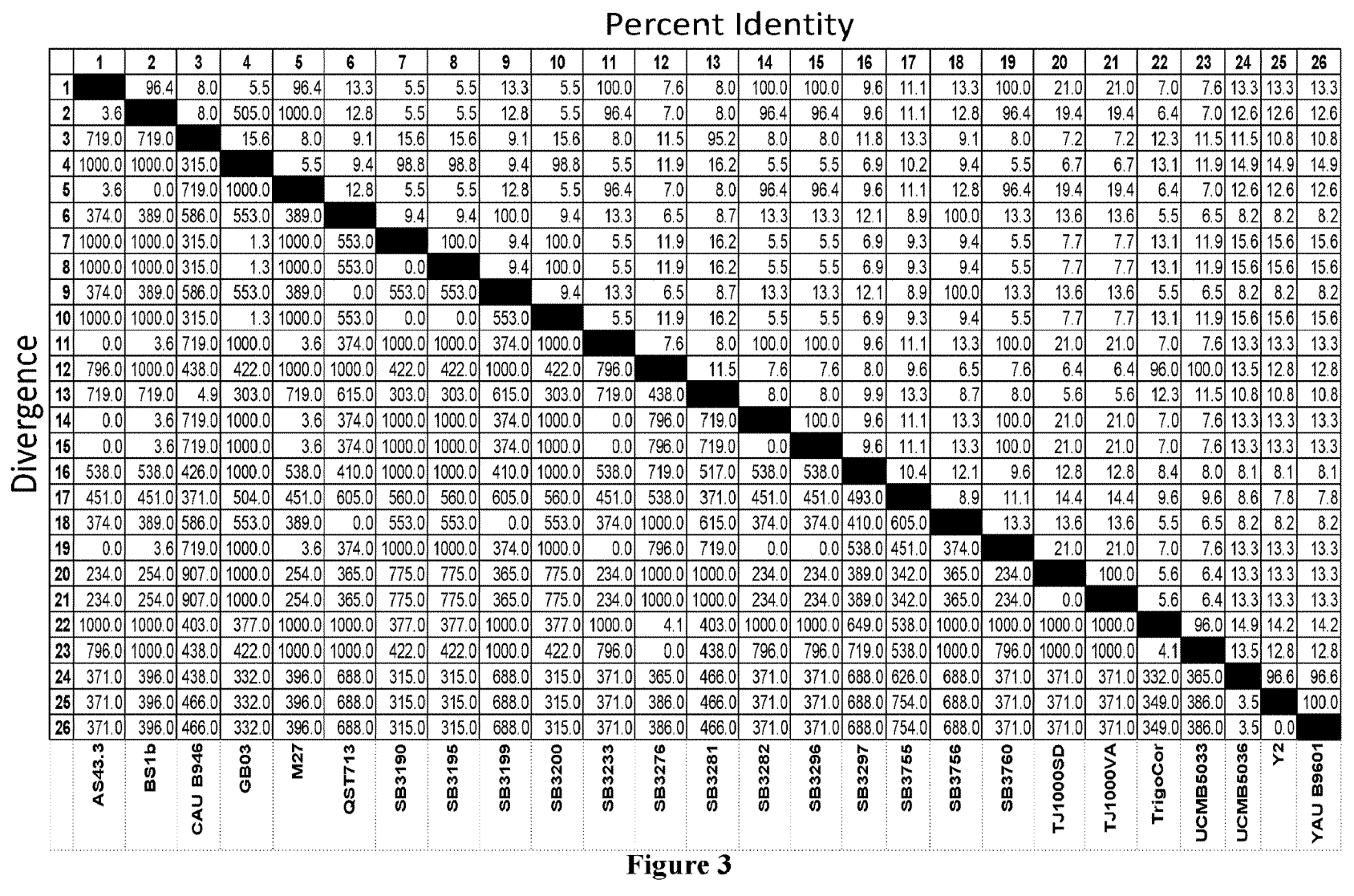
Figure 4:
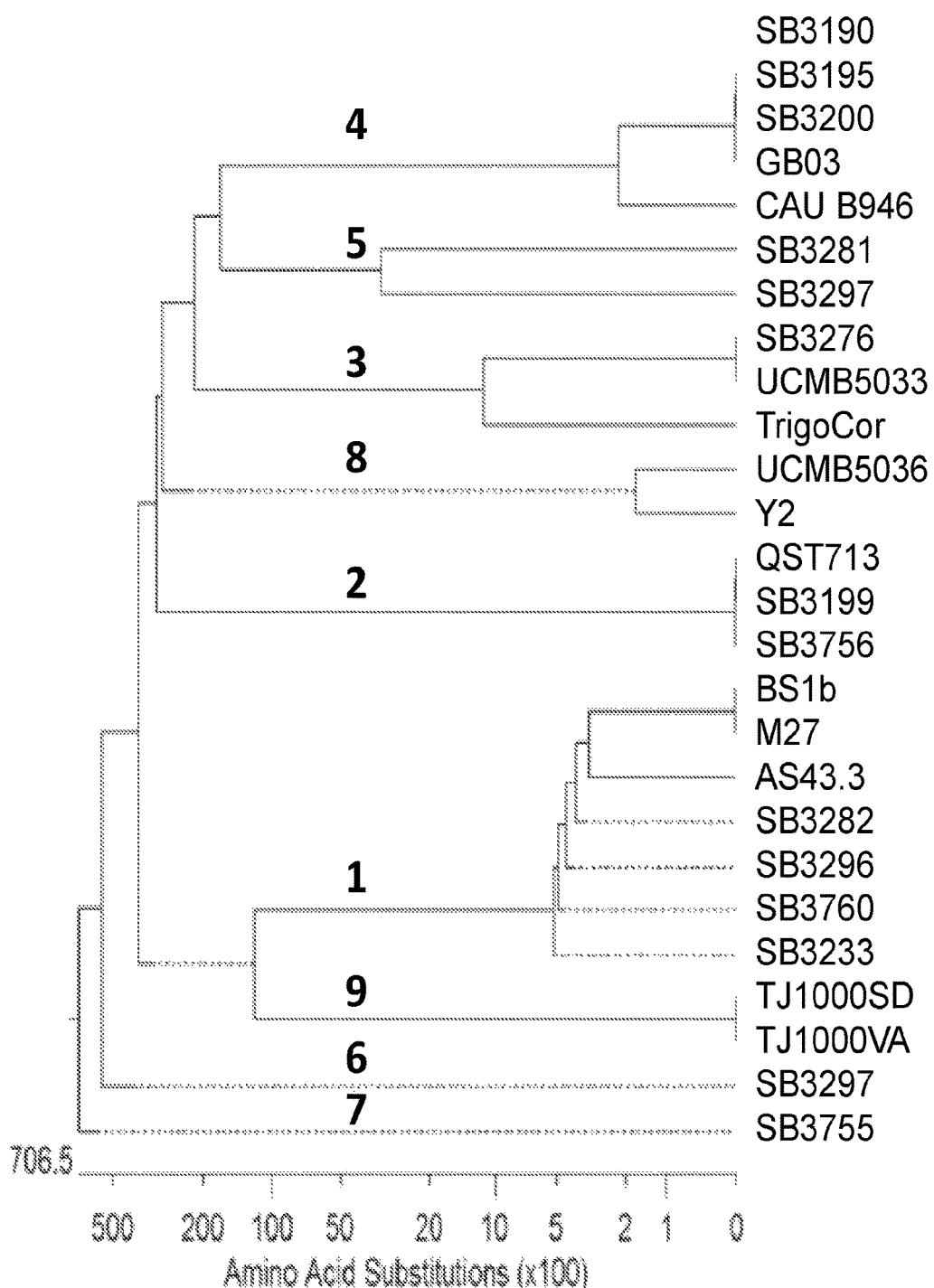

A similar comparing and classifying for *Bacillus amyloliquefaciens* WapI polypeptide sequences, as shown in Table 2, was performed as described in Example 3. Pair-wise sequence identities for the sequences are shown in FIG. 3. The sequence comparisons and results of classifying WapA-CT and are shown in FIG. 4. As shown in FIGS. 2 and 4, both WapA-CT and WapI sequences were classified into 9 Wap Groups.

Due to their co-linear arrangement within the bacterial genome, WapA-CT and WapI from the same *Bacillus amyloliquefaciens* strains co-segregated. Co-segregating WapA-CT and WapI were classified into the same Wap Groups, based on their amino acid identities. Within Wap Groups that contained multiple members (i.e., Wap Groups 1-5, 8 and 9), the amino acid identities of WapA-CT polypeptides were not less than 97.5% (Table 5). For WapA-CT polypeptides classified into different Wap Groups, the polypeptides were no greater than 71.8% identical, and as low as 32.3% identical. Within Wap Groups that contained multiple members, the amino acid identities of WapI polypeptides were not less than 95.2%. For WapI polypeptides classified into different Wap Groups, the polypeptides were no greater than 21.0% identical, and as low as 5.5% identical.

TABLE 5

Classifying of WapA-CT and WapI amino acid sequences into Wap Groups

| Wap Group | Number WapA-CT members[1] | Minimum identity between WapA-CT Group members[2] (%) | Range identities with WapA-CT non-Group members[2] (%) | Number WapI members[1] | Minimum identity between WapI Group members[3] (%) | Range identities with WapI non-Group members[3] (%) |
|---|---|---|---|---|---|---|
| 1 | 7 | 97.5 | 36.0-58.4 | 7 | 96.4 | 5.5-21.0 |
| 2 | 3 | 100 | 36.3-56.2 | 3 | 100 | 5.5-13.6 |
| 3 | 3 | 98.5 | 38.3-61.5 | 3 | 96.0 | 5.5-14.9 |
| 4 | 4 | 100 | 35.1-58.4 | 4 | 98.8 | 5.5-16.2 |
| 5 | 2 | 99.5 | 37.1-71.8 | 2 | 95.2 | 5.6-16.2 |
| 6 | 1 | — | 37.7-71.8 | 1 | — | 6.9-12.8 |
| 7 | 1 | — | 35.4-42.5 | 1 | — | 7.8-14.4 |
| 8 | 2 | 99.5 | 32.3-38.3 | 2 | 96.6 | 7.8-15.6 |
| 9 | 2 | 100 | 32.3-56.2 | 2 | 100 | 5.6-21.0 |

[1]Values obtained from Table 6 in Example 1
[2]Values obtained from FIG. 1Values obtained from FIG. 3

In addition, the data showed that, at the level of amino acid sequence identity, the Wap sequences from *Bacillus amyloliquefaciens* were largely different from Wap sequences from *Bacillus subtilis* (Example 3). When the 8 WapA-CT amino acid sequences from *Bacillus subtilis* were included along with WapA-CT amino acid sequences from *Bacillus amyloliquefaciens*, and were used to determine a phylogenetic tree/dendogram of the sequences, the arrangement shown in FIG. 5 was obtained. The data showed that 2 of the 8 *Bacillus subtilis* WapA-CT sequences grouped together with a single *Bacillus amyloliquefaciens* Wap-CT sequence in Wap Group 6. The other 6 *Bacillus subtilis* WapA-CT amino acid sequences grouped into 3 different Wap Groups, all 3 of these Wap Groups containing only *Bacillus subtilis* sequences, and all 3 Wap Groups distinct from the 9 *Bacillus amyloliquefaciens* Wap Groups. Therefore, the *Bacillus subtilis* Wap sequences are largely distinct from the *Bacillus amyloliquefaciens* Wap sequences. In one example, the *Bacillus amyloliquefaciens* sequences claimed herein do not include one or more of WapA, WapA-CT and WapI sequences from *Bacillus subtilis* (i.e., the *Bacillus subtilis* sequences are excluded). In one example, the *Bacillus amyloliquefaciens* sequences claimed herein do not include one or more of WapA, WapA-CT and WapI sequences from *Bacillus subtilis* that could be classified into Wap Group 6 based on sequence identity (e.g., sequences from at least *Bacillus subtilis* strains RO-NN and TU-B-10 are excluded).

Although the *Bacillus subtilis* study discussed earlier reported no strains of *Bacillus subtilis* that did not contain wapA/wapI genes (Koskiniemi, et al., 2013, Rhs proteins from diverse bacteria mediate intercellular competition, *Proc. Natl. Acad. Sci. USA* 110:7032-7037), this was not the case for *Bacillus amyloliquefaciens*. The studies disclosed herein showed no wapA or wapI nucleotide sequences in 8 out of 8 tested *Bacillus amyloliquefaciens* subsp. *amyloliquefaciens* strains. The studies herein also showed that wapA and wapI nucleotide sequences were present in *Bacillus amyloliquefaciens* subsp. *plantarum* strains, but only in about 78% of those strains (32 examined). Therefore, the situation in *Bacillus amyloliquefaciens* is different than in *Bacillus subtilis*.

Functions of Wap Proteins/Polypeptides

The *Bacillus subtilis* work (Koskiniemi, et al., 2013, Rhs proteins from diverse bacteria mediate intercellular competition, *Proc. Natl. Acad. Sci. USA* 110:7032-7037) showed that expression of a WapA-CT polypeptide (the C-terminal 200 amino acids of WapA) inhibited growth of/was toxic to the bacterial cell in which it was expressed. Co-expression of WapI in the same cell protected against the growth suppression/toxicity when the wapI encoding the WapI was the same allele that co-segregated with the wapA allele that encoded the WapA in the cell (i.e., when the WapA-CT and WapI were "cognate" pairs; from the same Wap Group). In addition, biochemical studies showed that expression of WapA-CT polypeptides in cells caused cleavage of tRNA molecules within the cells, suggesting a mechanism for this particular WapA-mediated growth inhibition. The tRNAase activity of WapA-CT polypeptides was blocked by co-expression in the cells of its cognate WapI protein, but not by co-expression of non-cognate WapI proteins. These data, therefore, showed that the 4 co-segregating wapA/wapI alleles represented 4 functional, cognate growth inhibiting (wapA)/protection from growth inhibition (wapI) gene/protein pairs in *Bacillus subtilis*.

In one example, a bacterium expressing a *Bacillus amyloliquefaciens* WapA protein or WapA-CT polypeptide may inhibit growth of a second bacterium when the second bacterium does not express a WapI protein, or expresses a WapI protein that is not functional to protect against growth inhibition. Generally, contact between the first and second bacterium may occur in order for growth inhibition to occur. If the second bacterium expresses a WapI protein, the second bacterium may be protected from growth inhibition by the WapA-expressing bacterium. In one example, the first and/or second bacterium may be a *Bacillus* organism. In one example, the first and/or second bacterium may be a *Bacillus subtilis* organism. In one example, the first and/or second bacterium may be a *Bacillus amyloliquefaciens* organism.

In light of the *Bacillus subtilis* work, the *Bacillus amyloliquefaciens* Wap Groups disclosed herein may be considered functional groups. In one example, a bacterium expressing a *Bacillus amyloliquefaciens* WapA protein or WapA-CT polypeptide may inhibit growth of a second bacterium, if the second bacterium does not express a WapI protein, expresses a WapI protein that is not functional to protect against growth inhibition, or if the second bacterium expresses a WapI protein from a Wap Group other than the Wap Group from which the WapA protein has been classified. Generally, contact between the first and second bacterium may occur in order for growth inhibition to occur. If the second bacterium expresses a WapI protein that is classified into the same Wap Group into which the WapA protein has been classified, the second bacterium is at least partially protected from growth inhibition by the WapA-expressing bacterium. In one example, the first and/or second bacterium may be a *Bacillus* organism. In one example, the first and/or second bacterium may be a *Bacillus subtilis* organism. In one example, the first and/or second bacterium may be a *Bacillus amyloliquefaciens* organism.

Vectors and Bacteria Expressing the Vectors

Herein, vectors are considered to be nucleic acid molecules that encode one or more polypeptides or proteins that are capable of being introduced into bacterial cells so that the encoded polypeptides/proteins are expressed in the bacterial cell. In one example, a vector may include minimal nucleotide sequences other than those that actually encode the one or more polypeptides or proteins. One such system may include nucleotide sequences that encode the polypeptides/proteins intended to be expressed, plus other nucleotide sequences that may facilitate recombination and/or incorporation into the genome of a bacterial cell into which the vector is introduced. In one example, a vector may include substantial nucleotide sequences other than those that actually encode the one or more polypeptides or proteins. One such system may include one or more plasmid vectors, bacteriophage vectors, and the like, that also encode the one or more polypeptides or proteins that are intended to be expressed in the bacterial cell. Vectors generally may encode nucleotide sequences that facilitate expression of encoded polypeptides/proteins (e.g., sequences that facilitate transcription and translation). In one example, introduction of single vectors into bacterial cells may be performed. In one example, introduction of two or more vectors into bacterial cells may be performed. In one example, the vector or vectors may encode at least one polycistronic mRNA. In one example, the vector or vectors may encode an operon under the control of a single transcriptional promoter.

Generally, the vectors include one or more nucleotide sequences that encode one or more of WapA-CT, WapA and WapI. In various examples, a vector may encode a WapI polypeptide or protein, may encode a WapA-CT or WapA polypeptide or protein, or may encode a WapA-CT/WapA polypeptide or protein and a WapI polypeptide or protein. In one example, multiple vectors may encode a combination of the above polypeptides or proteins. The multiple vectors may be designed to be introduced into bacterial cells such that the cells simultaneously express the combination of the polypeptides or proteins.

Single or multiple vectors may also include nucleotide sequences that encode more than one of the WapI, WapA-CT and/or WapA polypeptides/proteins. In one example, single or multiple vectors are designed to express 2, 3, 4, 5, 6, 7, 8, 9, or more, WapI proteins in a bacterial cell. In one example, the WapI proteins expressed are from different Wap Groups. In one example, single or multiple vectors may encode one or more WapA-CT and/or WapA polypeptides or proteins, and encode one or more cognate WapI proteins. The vector(s) may be designed to express 1, 2, 3, 4, 5, 6, 7, 8, 9, or more, such cognate pairs. The multiple vectors may be designed to be introduced into bacterial cells such that the cells simultaneously express the combination of the polypeptides or proteins.

In one example, the bacterial cells into which the vectors may be introduced/expressed (e.g., host cells) may be *Bacillus* bacterial cells. In one example, the bacterial cells into which the vectors may be introduced/expressed may be *Bacillus subtilis* bacterial cells. In one example, the bacterial cells into which the vectors may be introduced/expressed may be *Bacillus amyloliquefaciens* bacterial cells. A number of systems for introducing genes into these cells are known in the art. A number of vector and transcriptional promoter systems for use with such genes are known in the art. Generally, these systems facilitate so-called stable expression of the introduced polypeptides/proteins in the bacterial cells (e.g., self-replicating plasmids, integration of nucleotide sequences into the bacterial chromosome), although systems for transient expression of the introduced polypeptides/proteins in the bacterial cells may be used.

In various examples, the host cells for the vectors may include strains of *Bacillus amyloliquefaciens* or *Bacillus subtilis* known in the art, and may include mutants or variants of those strains. In one example, *Bacillus amyloliquefaciens* host strains for the vectors disclosed herein could include FZB24 (Taegro® product), BS1b (Biostart TripleX™ product), QST713 (Bayer CropScience Serenade® product), FZB42 (ABiTEP GMBH RhizoVital® product), and others.

In various examples, the host cells for the vectors may include the following strains of *Bacillus amyloliquefaciens*, and mutants or variants thereof: *Bacillus amyloliquefaciens* strain BS27, *Bacillus amyloliquefaciens* strain BS2084, *Bacillus amyloliquefaciens* strain 15AP4, *Bacillus amyloliquefaciens* strain 3AP4, *Bacillus amyloliquefaciens* strain LS SA01, *Bacillus amyloliquefaciens* strain ABP278, *Bacillus amyloliquefaciens* strain 1013, *Bacillus amyloliquefaciens* strain 918, *Bacillus amyloliquefaciens* strain 22CP 1, *Bacillus amyloliquefaciens* strain BS18, *Bacillus amyloliquefaciens* strain BA842, *Bacillus amyloliquefaciens* strain BL21, *Bacillus amyloliquefaciens* strain IN937a, *Bacillus amyloliquefaciens* strain B3, *Bacillus amyloliquefaciens* strain D747, and others.

In various examples, the host cells for the vectors may include the following strains of *Bacillus subtilis*, and mutants or variants thereof: *Bacillus subtilis* strain 3BP5, GB03 (Growth Products Companion® product), and others.

Other bacteria that may be host cells for the vectors disclosed herein may include *Bacillus chitinosporus* strain AQ746, *Bacillus mycoides* strain AQ726, *Bacillus pumilus* strain AQ717, *Bacillus* sp. AQ175, *Bacillus* sp. AQ177, *Bacillus* sp. AQ178, *Bacillus subtilis* strain AQ743, *Bacillus subtilis* strain AQ713, *Bacillus subtilis* strain AQ153, *Bacillus thuringiensis* strain BD#32, *Bacillus thuringiensis* strain AQ52, *Bacillus thuringiensis* subspec. *kurstaki* BMP 123, and mutants or variants of these bacteria.

Methods

Also disclosed herein are methods. In one example, methods for introducing into *Bacillus* cells, any of the vectors described herein are disclosed. The cells resulting from these methods have been constructed to express the Wap polypeptides/proteins that are generally encoded by the vectors. Generally, *Bacillus* cells can be constructed to express one or more WapI polypeptides/proteins, independent of whether the cells express WapA. *Bacillus* cells constructed to express WapA, generally are simultaneously constructed to express a WapI that is functional to protect the cells against growth inhibition mediated by the WapA.

Bacterial cells constructed to express Wap polypeptides/proteins, by introducing vectors into the cells or otherwise, may be supplied to an environment. In one example, bacterial cells supplied to an environment may possess a phenotype that is advantageous for a purpose. Expression of one or both of WapA/WapI polypeptides/proteins in the cells may make the bacterial cells better suited for the purpose. In one example, the *Bacillus amyloliquefaciens* subsp. *plantarum* strain FZB24, which is present in the Taegro® product from Novozymes is, in part, a biofungicide/bactericide useful for suppressing certain soil-borne and/or foliar diseases on agricultural crops. As described in Example 6 herein, FZB24 does not express WapA or WapI. Lacking WapI expression, FZB24 that is supplied to the soil, may be susceptible to growth inhibition by bacteria in the soil that express WapA. Construction of an FZB24 to express one or more WapI proteins, for example, may provide the bacterium with protection against growth inhibition by bacteria in the soil that may express WapA. The WapI-expressing FZB24 bacterium may be more competitive than the parent FZB24 in the soil environment.

In one example of bacterial cells constructed to express Wap polypeptides/proteins that are supplied to an environment, expression of the Wap polypeptides/proteins may provide an additional phenotype to the cells that is advantageous for a purpose. For example, construction of FZB24 to express one or more WapA proteins (the cells would be constructed to also express cognate WapI proteins), may provide the bacterium with the capability to inhibit growth of bacteria in a soil environment, where at least some of the bacteria in the soil may not express one or more WapI proteins that are cognate to WapA proteins expressed in the constructed FZB24 strain. The WapA- and WapI-expressing FZB24 may be more competitive in the soil environment than the parent FZB24 strain.

In one example of a method disclosed herein, a nucleotide sequence is obtained from one or both of a wapA and wapI nucleic acid found in a *Bacillus amyloliquefaciens* bacterium, and the bacterium is classified into a Wap Group, generally based on sequence identities of the proteins encoded by the wapA and wapI nucleic acids. Sequences that possess substantial sequence identity with one another may be classified into the same Wap Groups. Sequences that do not possess substantial identity to known *Bacillus amyloliquefaciens* WapA/WapI sequences may be placed into a new Wap Group. Organisms classified into Wap Groups may be determined to be advantageous for a purpose, based on the classifying, and supplied to an environment, similar to what has already been discussed above.

Two or more *Bacillus amyloliquefaciens* organisms, containing wapA and/or wapI sequences, that have been classified into a Wap Group, may be determined to be Wap compatible or Wap non-compatible, and placed in proximity to one another based on the compatibility. In one example, where it is desired that two organisms survive/function/grow when they are placed together, organisms that are Wap compatible will be placed in proximity to one another. In one example, where it is desired that at least one of two organisms does not survive/function/grow when they are placed together, organisms that are Wap non-compatible will be placed in proximity to one another.

In one example of a method disclosed herein, a determination is made as to whether two strains of *Bacillus amyloliquefaciens* strains encode one or both of a wapA and wapI nucleotide sequences in their genomes. The wapA/wapI nucleic acids, or WapA/WapI proteins encoded by the nucleic acids, if present in the genomes, are compared to each other or to known sequences. The two strains are designated as Wap compatible or Wap non-compatible, based on presence/absence of the sequences, or based on comparing the sequences. Similar to what has already been described, the strains may be placed in proximity to one another, or may be supplied to an environment (e.g., a plant environment), based on the method. Compositions of two or more *Bacillus amyloliquefaciens* strains (e.g., two strains are Wap compatible) may be made, based on the method.

EXAMPLES

The following examples are for the purpose of illustrating various embodiments and are not to be construed as limitations.

Example 1. *Bacillus amyloliquefaciens* Strains, Genome Sequencing, and Sequence Assembly

*Bacillus amyloliquefaciens* subsp. *plantarum* strains were either internal Novozymes strains or were strains obtained from products purchased commercially, as indicated in Table 6. Genome sequences were determined internally for some of the strains, as described below. Genome sequences not determined internally were obtained from GenBank (NCBI), as indicated in Table 6, and included in the analyses.

TABLE 6

*Bacillus amyloliquefaciens* subsp. *plantarum* strains used[1]

| Strain designation[2] | Origin of genome sequence | Wap Group[9] |
|---|---|---|
| SB3296 | Determined in this work | 1 |
| SB3760 | Determined in this work | 1 |
| AS43.3[8] | Genbank accession NC_019842.1 | 1 |
| SB3233 | Determined in this work | 1 |
| BS1b[3] | Determined in this work | 1 |
| M27[8] | Genbank accession NC_AMPK0000000.1 | 1 |
| SB3282 | Determined in this work | 1 |
| SB3199 | Determined in this work | 2 |
| SB3756 | Determined in this work | 2 |
| QST713[4] | Determined in this work | 2 |
| UCMB5033[8] | Genbank accession NC_022075.1 | 3 |
| SB3276 | Determined in this work | 3 |
| TrigoCor | Determined in this work | 3 |
| GB03[5] | Determined in this work | 4 |
| SB3190 | Determined in this work | 4 |
| SB3195 | Determined in this work | 4 |
| SB3200 | Determined in this work | 4 |
| CAU B946[8] | Genbank accession NC_016784.1 | 5 |
| SB3281 | Determined in this work | 5 |
| SB3297 | Determined in this work | 6 |
| SB3755 | Determined in this work | 7 |
| UCMB5036[8] | Genbank accession NC_020410.1 | 8 |
| Y2[8] | Genbank accession NC_017912.1 | 8 |
| TJ1000SD[6] | Determined in this work | 9 |
| TJ1000VA[7] | Determined in this work | 9 |

[1]All listed strains contained wapA sequences in their genomes
[2]Unless otherwise designated, all strains are Novozymes internal strains
[3]Strain contained in Biostart TripleX ™ product
[4]Strain contained in Bayer CropScience Serenade ® product
[5]Strain contained in Growth Products Companion ® product
[6]Strain contained in Novozymes Taegro ® product, SD stock
[7]Strain contained in Novozymes Taegro ® product, VA stock
[8]Not Novozymes strains
[9]Strains assigned to same groups based on similarity of WapA/WapI sequences as shown in Examples 2 and 3

For sequences that were determined internally, genomic DNA samples were purified from the bacteria using a previously described method (Pitcher et al., 1989, Rapid extraction of bacterial genomic DNA with guanidinium thiocyanate, *Lett. Appl. Microbiol.* 8:151-156). The purified DNA was sheared to an average size of 300 base pairs by sonication with a Covaris M220 focused ultrasonicator (Covaris, Inc., Woburn, Mass., USA). Sequencing libraries were prepared using the Apollo 324™ System (IntegenX, Inc., Pleasanton, Calif., USA). DNA sequencing was done on an Illumina MiSeq instrument (Illumina, Inc., San Diego, Calif., USA) as prescribed by the manufacturer. Illumina sequencing reads were trimmed using CLC Genomics Workbench 5 (CLCbio, Inc., Arhus, Denmark). The trimmed reads were assembled with a de novo assembly algorithm implemented in the CLC Genomics Workbench 5 software. GAPfiller (Boetzer and Pirovano, 2012, Toward almost closed genomes with GapFiller, *Genome Biol.* 13:R56) was used to reduce the number of undefined nucleotides in the genome assemblies using paired-reads to fill in the gapped regions within scaffolds. The sequences were assembled, annotated and made available for viewing with RAST (Aziz et al., 2008, The RAST server: rapid annotations using subsystems technology, *BMC Genomics* 9:75).

Example 2. Analysis and Grouping of *Bacillus amyloliquefaciens* WapA-CT Sequences For analysis of the genomic sequences, proteins encoded by wapA orthologues were identified using Blastp (Altschul et al., 1997, Gapped BLAST and PSI-BLAST: a new generation of protein database search programs, *Nucleic Acids Res.* 25:3389-3402) and *Bacillus subtilis* WapA (Genbank accession NP_391802) as the query sequence. For classification purposes, the C-terminal (WapA-CT) domains of the identified proteins, comprising 200 amino acids, were aligned using CLUSTALW (Thompson et al., 2002, Multiple sequence alignment using ClustalW and ClustalX, *Curr. Protoc. Bioinformatics* 2:2.3.1-2.3.22) included in the DNASTAR Lasergene™ Suite, version 7.2.1 (DNASTAR, Inc., Madison, Wis., USA). A sequence identity matrix was calculated for the WapA-CT sequences from the various strains (FIG. 1) and a phylogenetic tree was generated from these CLUSTALW alignments (Chenna et al., 2003, Multiple sequence alignment with the Clustal series of programs, *Nucleic Acids Res.* 31:3497-3500) (FIG. 2). From these analyses, WapA-CT amino acid sequences were classified into 9 discrete Wap Groups based on their sequence relatedness to one another, as shown in FIG. 2. The data showed that WapA-CT sequences within each of the 9 Wap Groups were no less than 97.5% identical, while percent identity between WapA-CT sequences from different Wap Groups ranged from a low of 32.3 to a high of 71.8 (FIG. 1).

Example 3. Analysis and Grouping of *Bacillus amyloliquefaciens* WapI Sequences From the initial sequence analyses, it was found that the chromosomal regions in which the wapA genes of *Bacillus amyloliquefaciens* were located appeared largely syntenic with the chromosomal regions of *Bacillus subtilis*. Since, in *Bacillus subtilis*, the wapA and wapI genes are immediately adjacent on the chromosome (i.e., wapI is immediately 3' of wapA)(Kunst et al., 1997, The complete genome sequence of the gram-positive bacterium *Bacillus subtilis*, *Nature* 390:249-256; Koskiniemi, et al., 2013, Rhs proteins from diverse bacteria mediate intercellular competition, *Proc. Natl. Acad. Sci. USA* 110:7032-7037), putative wapI genes in *Bacillus amyloliquefaciens* were assigned based on their location downstream (3') of the wapA coding sequences determined as described in Example 2. As already described for WapA-CT in Example 2, a sequence identity matrix was calculated for WapI (FIG. 3) and a phylogenetic tree was generated from the CLUSTALW alignments (FIG. 4). From these analyses, WapI amino acid sequences were classified based on their sequence relatedness to one another. Nine Wap Groups emerged for WapI, just as for WapA-CT. The Wap Groupings for both WapA-CT and for WapI appeared to be the same (i.e., WapA-CT sequences from the *Bacillus amyloliquefaciens* strains grouped together, based on sequence identity, the same as did WapI sequences from the strains) (FIG. 2 and Table 3). WapI sequences within each of the 9 Wap Groups were no less than 95.2% identical, while percent identity between WapI sequences from distinct Wap Groups ranged from a low of 5.5 to a high of 21.0 (FIG. 3).

Example 4. Comparison of WapA-CT Sequences from *Bacillus amyloliquefaciens* and *Bacillus subtilis*

The WapA-CT sequences from *Bacillus amyloliquefaciens* that have been analyzed and grouped (FIG. 2 and Table 3) were compared to WapA-CT sequences from a number of *Bacillus subtilis* organisms (Table 7). The genome sequences of these organisms were obtained from GenBank.

TABLE 7

*Bacillus subtilis* strains used

| Strain designation | Origin of genome sequence |
| --- | --- |
| subsp. *subtilis* strain 168 | Genbank accession NZ_CP010052 |
| BSn5 | Genbank accession NC_014976 |
| subsp. *subtilis* strain SC-8 | Genbank accession NZ_AGFW01000003 |
| subsp. *spizizenii* strain NRS 231 (ATCC 6633) | Genbank accession NZ_CP010434 |
| subsp. *spizizenii* strain W23 | Genbank accession NC_014479 |
| subsp. *subtilis* strain RO-NN-1 | Genbank accession NC_017195 |
| subsp. *spizizenii* TU-B-10 | Genbank accession NC_016047 |
| subsp. *natto* BEST195 | Genbank accession NC_017196 |

Figure 5:
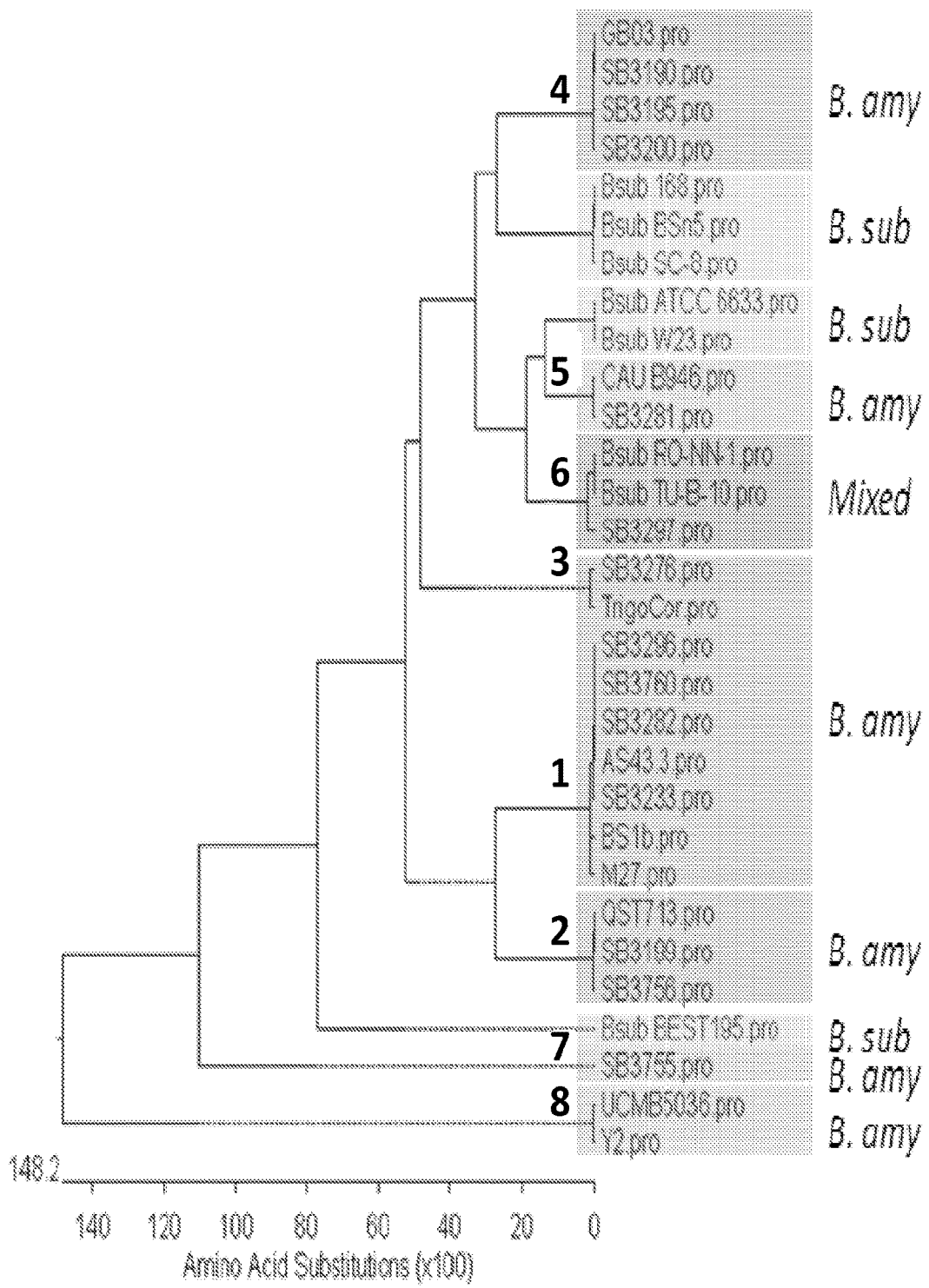

Using WapA-CT sequences from the *Bacillus amyloliquefaciens* strains indicated in Table 4, and from the *Bacillus subtilis* strains indicated in Table 7, a phylogenetic tree was generated, as shown in FIG. 5. The Wap Group numbers shown in FIG. 5 indicate the same Wap Groupings as determined in Example 2 (FIG. 2 and Table 4).

The data showed that, in the majority of cases, WapA-CT sequences from *Bacillus subtilis* were distinct from those from *Bacillus amyloliquefaciens* (FIG. 5). Six of the eight *Bacillus subtilis* strains formed groups containing only *Bacillus subtilis* WapA-CT sequences (these groups labelled as "B. sub" in FIG. 5). Two of the *Bacillus subtilis* WapA-CT sequences, however (RO-NN-1 and TU-B-10), were grouped with *Bacillus amyloliquefaciens* strain SB3297 in Wap Group 6 (the group labelled as "Mixed" in FIG. 5). These data indicated that *Bacillus amyloliquefaciens* WapA, and likely WapI sequences (24 out of 25), were largely distinct from *Bacillus subtilis* WapA sequences.

Example 5. Construction of a Plasmid Expressing WapI from *Bacillus amyloliquefaciens* Strain SB3281

A plasmid called pBM347, expressing the WapI protein from *Bacillus amyloliquefaciens* strain SB3281, was constructed using a three-step process. In the first step, the plasmid vector, pBM346a, was constructed. As described below, pBM346a contained wap sequences from *Bacillus subtilis* strain 168. In the second step, the wapI coding sequence from *Bacillus amyloliquefaciens* strain SB3281 was prepared. In the third step, the insert from the second step was constructed into the vector from the first step to yield the WapI-expressing plasmid, called pBM347.

In the first step, the plasmid vector, pBM346a was constructed as follows. The primers below were used to amplify the wapI gene from *Bacillus subtilis* strain 168.

Primer 1205397
(SEQ ID NO: 66)
5'<u>TCTAGA</u>TCGAAAGCAAGG*AGGAGC*AGACGTATGGCCAAAATAAAAGA TGATTGTATAG3'

Primer 1205398
(SEQ ID NO: 67)
5'<u>AAGCTT</u>AAAAAAACGCTGTGCCCTTTAACCGCACAGCGTTTTTTTTT AAGGAAGTTTAGAAGG3'

Primer 1205397 contained a recognition sequence for HindIII (underlined) and a ribosome binding site (italics). Primer 1205398 contained a recognition sequence for XbaI (underlined) and a transcriptional termination signal. Both primers contained wapI sequences (bold).

PCR was performed using the primers and *Bacillus subtilis* strain 168 DNA as template under standard conditions to obtain a 504 base-pair amplified fragment, which was purified by agarose gel electrophoresis. The fragment was cloned into plasmid pCR2.1-TOPO (Invitrogen, Carlsbad, Calif., USA) to yield a plasmid called pBM345.

pBM345 and another plasmid, called pBD2528 (described in PCT publication no. WO2008/079895) were both digested with HindIII and XbaI restriction endonucleases. A 498 base pair fragment was purified from pBM345. A 6935 base pair fragment was purified from pBD2528. These two fragments were ligated and used to transform *Escherichia coli* cells. Plasmids from transformants were screened. A plasmid identified as having the expected restriction endonuclease pattern on agarose gels was designated pBM346a.

The primers below were then used to amplify the vector sequences from pBM346a.

Primer 1206817
(SEQ ID NO: 68)
5'CGATTTATATCTGGTGAAGTATTGAAAAAAAAACGCTGTGCGGTTAAA GGGC3'

Primer 1206818
(SEQ ID NO: 69)
5'CGCTCCGCGGTAAGTTCTAACATACGTCTGCTCCTCCTTGCTTTCG3'

Both primers contained wapI sequences (bold).

PCR was performed using the primers and pBM346a plasmid under standard conditions to obtain a 7001 base-pair amplified fragment, which was purified by gel electrophoresis.

In step 2, the primers below were used to amplify the wapI gene from *Bacillus amyloliquefaciens* strain SB3281.

Primer 1206815
(SEQ ID NO: 70)
5'CGAAAGCAAGGAGGAGCAGACGTATGTTAGAACTTACCGCGGA GCG3'

Primer 1206816
(SEQ ID NO: 71)
5'GCCCTTTAACCGCACAGCGTTTTTTTTCAATACTTCACCAGAT ATAAATCG3'

Both primers contained wapI sequences (bold). Primer 1206815 was complementary to primer 1206818. Primer 1206816 was complementary to primer 1206817.

PCR was performed using the primers and *Bacillus amyloliquefaciens* strain SB3281 DNA as template under standard conditions to obtain an 868 base-pair amplified fragment, which was purified by agarose gel electrophoresis.

In step 3, the 7001 base-pair fragment from pBM346a was joined to the 868 base-pair wapI fragment from *Bacillus amyloliquefaciens* strain SB3281 using an In-Fusion PCR Cloning Kit (Clonetech, Mountain View, Calif., USA) and a portion of the reaction mixture was used to transform *Escherichia coli* cells. Plasmids from transformants were screened. A plasmid identified as having the expected restriction endonuclease pattern on agarose gels was designated as pBM347.

Example 6. Protection from Growth Inhibition after Expression of WapI

Although many strains of *Bacillus amyloliquefaciens* were found to contain wapA/wapI genes (Examples 2 and 3), strains of *Bacillus amyloliquefaciens* were also found that did not contain wapA/wapI genes (about 78% of tested *Bacillus amyloliquefaciens* subsp. *plantarum* strains contained wap sequences; no wap sequences were found in 8 tested strains of *Bacillus amyloliquefaciens* subsp. *amyloliquefaciens*). One strain of *Bacillus amyloliquefaciens* subsp. *plantarum* found not to contain wapA/wapI genes was *Bacillus amyloliquefaciens* strain FZB24. FZB24 is the strain used in Novozymes' Taegro® product.

The ability of the FZB24 strain to grow in co-cultures with *Bacillus amyloliquefaciens* strains that contain wapA/wapI genes was tested. FZB24 was co-cultured with the SB3281 strain of *Bacillus amyloliquefaciens*. The SB3281 strain was shown to contain wapA/wapI genes and was previously placed into Wap Group 5 (Tables 2 and 4 and FIGS. 2 and 4). To perform the co-culturing experiment, both the FZB24 and SB3281 strains were separately grown to the mid-exponential phase of growth. The cultures were then mixed together and grown over night. Control cultures, containing cultures of FZB24 and SB3281, that were not mixed together, were also included. After the overnight incubation, both the control and co-cultured cultures were diluted and plated on agar plates, so colonies could be enumerated. FZB24 colonies have a distinctive colony morphology that allowed them to be differentiated from colonies formed by the SB3281 strain.

Figure 6:
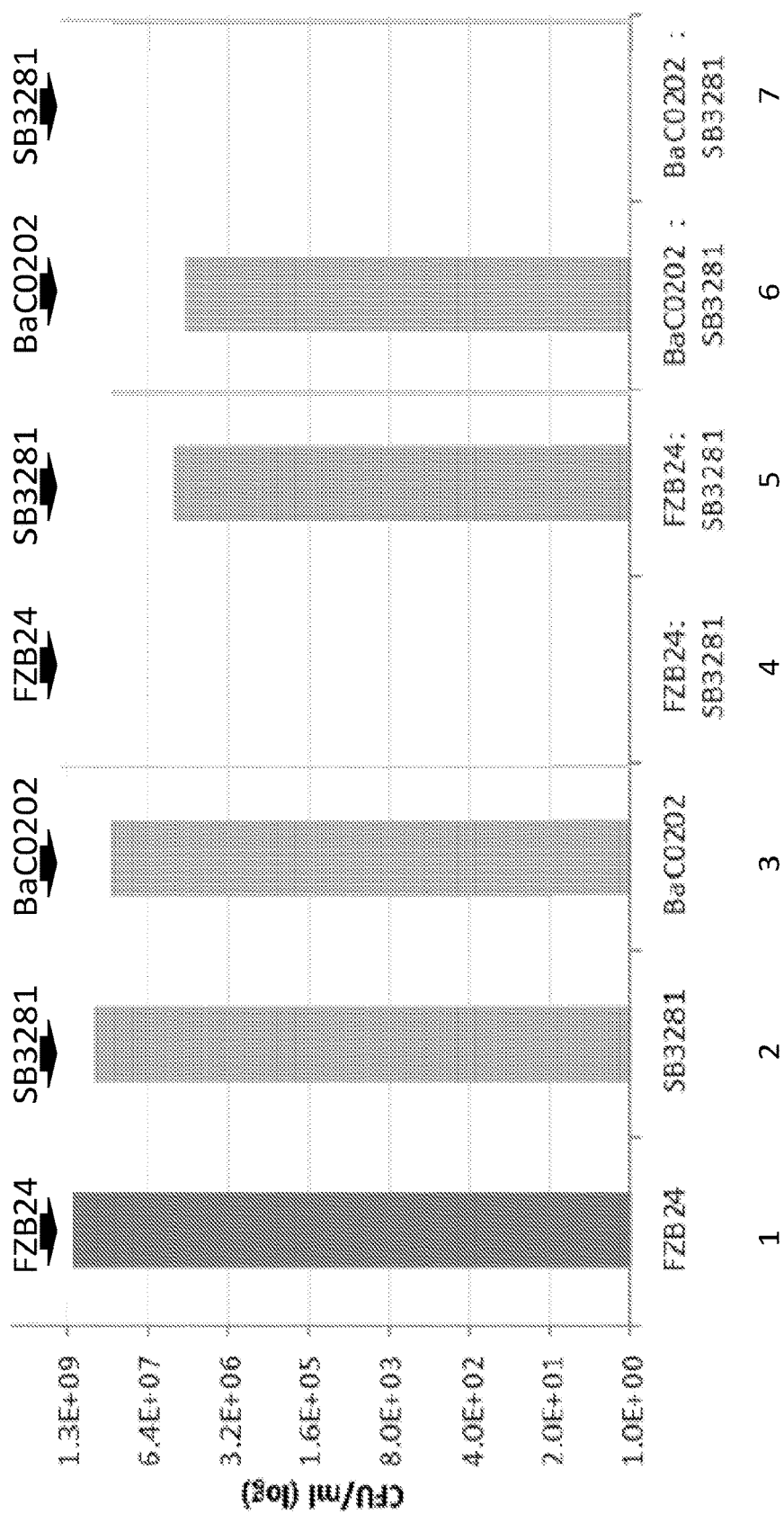

The data from the example experiment are shown in FIG. 6. Cultures of individual strains (bars labeled 1-3) and co-cultures of two strains (bars labeled 4-7) are indicated on the x-axis of FIG. 6. Colony counts from the various cultures/co-cultures were expressed on the y-axis of FIG. 6 as colony-forming-units (CFU) per ml of culture. For the co-cultures (bars labeled 4-7), the strain whose CFU counts are represented by the bar is indicated on the top of the chart by the arrows.

The results indicated that both of the control cultures, FZB24 (FIG. 6, bar labeled 1) and SB3281 (FIG. 6, bar 2) grew well, with a titer of CFU of $10^8$-$10^9$ per ml of culture. However, when FZB24 was co-cultured with SB3281, CFU per ml for FZB24 were reduced at least $10^4$-fold (FIG. 6, bar 4), while SB3281 grew well in the co-culture, with a CFU of about $10^7$ per ml of culture (FIG. 6, bar 5).

If the reduction in FZB24 growth in co-cultures with SB3281 was caused by WapA produced by the SB3281 strain, expression of SB3281 WapI in FZB24 would be expected to increase FZB24 growth. To test this, pBM347 (from Example 5), encoding WapI from SB3281, was transformed into FZB24. The pBM347-transformed FZB24 strain was designated BaC0202.

When the WapI-expressing FZB24 strain, BaC0202, was co-cultured with SB3281, BaC0202 growth was increased (FIG. 6, bar 6) and actually grew to similar levels as SB3281 (compare FIG. 6, bar 6 with bar 5). Therefore, WapI from strain SB3281 protected FZB24 from WapA-induced growth inhibition by strain SB3281. Interesting was that SB3281 growth was reduced in co-cultures with BaC0202 (FIG. 6, bar 7). Our data suggest that a set of genes distinct from wapA/wapI may be responsible for decreased growth of the SB3281 strain.

Example 7. WapI Expression Protects Against WapA-Growth Inhibition when WapI and WapA are from the Same Wap Group In the experiment described in Example 6, the WapI protein expressed in FZB24 (i.e., in the BaC0202 strain) was from strain SB3281, and protected FZB24 from growth inhibition by strain SB3281, which expressed WapA protein. In this experiment, both WapI and WapA were from Group 5 (FIGS. 4 and 2, respectively, and Tables 2 and 4). If the 9 Wap Groups into which the *Bacillus amyloliquefaciens* WapA/WapI proteins have been classified are functional groups, WapI proteins from one of the 9 groups would be expected to protect against growth inhibition by WapA from the same Wap Group (i.e., cognate pairs) but not against growth inhibition by a WapA from a different Wap Group.

To test this, co-culture experiments similar to those shown in Example 6 will be performed. In a first experiment, FZB24 is co-cultured with SB3755. SB3755 contains wapA/wapI genes, but these genes have been placed into Wap Group 7, not Wap Group 5 as for SB3281. When the experiment is performed, the data are that SB3755 grows well in co-culture, but that there is a reduction in growth of FZB24, which does not contain wapA/wapI genes. SB3755, therefore, is expected to reduce FZB24 growth in co-cultures in the same way that SB3281 reduced growth of FZB24 in co-cultures, as shown in Example 6.

In a second experiment, the BaC0202 strain (FZB24 expressing WapI from Wap Group 5, as described in Example 6) is co-cultured with SB3755. The data are that there is a reduction in growth of BaC0202, which expresses WapI from Wap Group 5, but no WapA protein, while SB3755 grows well. Again, SB3755 expresses both WapA and WapI proteins from Wap Group 7. Therefore, SB3755 (because it expresses WapA) is expected to reduce BaC0202 growth in co-cultures (because, although BaC0202 expresses WapI, the WapI is not cognate with WapA from SB3755). The conclusion is that the Group 5 WapI protein that is expressed in the BaC0202 strain is not protective against growth inhibition mediated by the Group 7 WapA protein of SB3755.

Example 8. Simultaneous Expression of WapI Proteins from Different Wap Groups Protects Against Growth Inhibition by Multiple WapA Proteins An experiment is performed to test whether cells expressing WapI proteins from multiple Wap Groups are resistant to growth inhibition by the multiple WapA proteins from those Wap Groups.

A gene sequence is synthesized that includes the complete coding regions of the wapI genes from strains SB3281 and SB3755. The coding sequences are synthesized, in tandem, such that a single polycistronic mRNA will be transcribed from the synthesized gene sequence, when placed downstream from a transcriptional promoter. The polycistronic mRNA will encode a Shine-Dalgarno sequence upstream of the coding region nearest the 5' end of the mRNA. The separate SB3281 and SB3755 sequences within the polycistronic mRNA will each have their own start and stop codons. The synthesized sequence is constructed into a plasmid vector, downstream of a transcriptional promoter. The plasmid is used to transform FZB24 cells.

The FZB24 cells constructed to express WapI proteins from both strains SB3281 (Wap Group 5) and SB3755 (Wap Group 7), are co-cultured with strain SB3755 (Wap Group 7) and, separately, co-cultured with strain SB3281 (Wap Group 5), using the co-culturing method described in Example 6. The data are that the FZB24 cells expressing both the SB3281 and SB3755 WapI proteins, grow well, both in co-culture with strain SB3281, and in co-culture with strain SB3755, without indication that either SB3281 or SB3755 decreases growth of the FBZ24 dual WapI-expressing cells. Control FZB24 cells, not expressing any WapI protein, will be growth inhibited by WapA from both SB3755 and SB3281.

The conclusion is that multiple wapI genes, from different of Wap Groups, are expressed in the same cells. The conclusion also is that cells expressing WapI from different of the Wap Groups are protected from growth inhibition by the multiple WapA proteins, when the WapI proteins are from the same groups (i.e., cognate) as are the WapA proteins.

While example compositions, methods, and so on have been illustrated by description, and while the descriptions are in considerable detail, it is not the intention of the applicants to restrict or in any way limit the scope of the application. It is, of course, not possible to describe every conceivable combination of components or methodologies for purposes of describing the compositions, methods, and so on described herein. Additional advantages and modifications will readily appear to those skilled in the art. Therefore, the invention is not limited to the specific details and illustrative examples shown and described. Thus, this application is intended to embrace alterations, modifications, and variations that fall within the scope of the application. Furthermore, the preceding description is not meant to limit the scope of the invention.

To the extent that the term "includes" or "including" is employed in the detailed description or the claims, it is intended to be inclusive in a manner similar to the term "comprising" as that term is interpreted when employed as a transitional word in a claim. Furthermore, to the extent that the term "or" is employed in the detailed description or claims (e.g., A or B) it is intended to mean "A or B or both". When the applicants intend to indicate "only A or B but not both" then the term "only A or B but not both" will be employed. Thus, use of the term "or" herein is the inclusive, and not the exclusive use. See, Bryan A. Garner, A Dictionary of Modern Legal Usage 624 (2d. Ed. 1995). Also, to the extent that the terms "in" or "into" are used in the specification or the claims, it is intended to additionally mean "on" or "onto." Furthermore, to the extent the term "connect" is used in the specification or claims, it is intended to mean not only "directly connected to," but also "indirectly connected to" such as connected through another component or components.

SEQUENCE LISTING (113 sequences)

SEQ ID NO: 1 - DNA, 603 bp, Bacillus amyloliquefaciens
atggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcagcttcgaactttggtcctgggaaaatatttaagggtgctagtcggatttataaagctgctaaaacatataaactatctagaaaaagtgtacgggctagaagggcctactcaagttatagggatataactggaaaaacctctaggttcaaaaattattctactaatgtaagaagaagaacttttgaaaaaaatttaagaagacaaggatggagaaaatcagttcatcatgggggtgttatcactatgacgaaaaatgggaataagtattccctaaggaaacatgctaagtcaagtccttatccaaccgcggaatatacacctaaaggtagaaaaaaattcacacacaaaatcagaatgcgacattaa

SEQ ID NO: 2 - DNA, 603 bp, Bacillus amyloliquefaciens
atggcccgctactacgaaccaagaaacggcgtgttcttatcactcgacccagacccgggaagtgacggcgattctttagatcagaatggatatgcatacggaaacaacaacccggtgatgaacgtcgatcctgacgggcattgggtgtggcttgtggtaaatgccggatttgcagcctatgatggatataaggcctataaatcaggtaaaggatggagaggtgcagcctgggcagcggcttcgaactttggtcctgggaagttatttaagggtgctagtcggatttataaagctgctaaaacatataaactatctagaaaaagtgtacgggctagaagggcctactcaagttatagggatataactggaaaaacctctaggttcaaaaattattctactaatgtaagaagaagaacttttgaaaaaaatttaagaagacaaggatggagaaaatcagttcatcatggaggtgttatcactatgacgaaaaatgggaataagtattccctaaggaaacatgctaagtcaagtccttatccaaccgcggaatatacacctaaaggtagaaaaaaattcacacacaaaatcagaatgcgacattaa

SEQ ID NO: 3 - DNA, 603 bp, Bacillus amyloliquefaciens
atggcccgctactatgagccaagaaacggcgtattcttatcactagacccagacccgggcagcgacggagattcgctcgatcagaatgggtatacttatggaaacaacaacccagtcatgaacgtcgatccggatgggcattgggtgtggcttgtggtaaatgccggatttgcagcctatgatggatataaggcatataaatcaggtaaaggatggagaggtgcagcctgggcagcggcttcgaactttgggcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaa

SEQ ID NO: 4 - DNA, 603 bp, Bacillus amyloliquefaciens
atggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttgggcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaa

SEQ ID NO: 5 - DNA, 603 bp, Bacillus amyloliquefaciens
cgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcagcttcgaactttgggcccgggaaagtgtttaaaggtgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtga

SEQ ID NO: 6 - DNA, 603 bp, Bacillus amyloliquefaciens
cgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggcagcggcttcgaactttgggcccgggaaagtgtttaaaggtgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtga

SEQ ID NO: 7 - DNA, 603 bp, Bacillus amyloliquefaciens
cgctactacgaaccaagaaacggtgtattcttatcactagacccagacccgggaagtgacggcgattctttagatcagaatggatatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagcggcttcgaactttgggcctgggaaagtgtttaaaggcgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtga

SEQ ID NO: 8 - DNA, 603 bp, Bacillus amyloliquefaciens
gacgaagaaaccggcctgtactatctcatggcccgctactacgagccaagaaacggcgtattcttatcactcgatccagacccgggaagcgacggagattcgctggatcagaatggatatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagcggcttcgaactttggtcctgggaagttatttaagggtgctaaaagggtttataaagcggttcattctgtctatgttttaaaaaaaggaaagaaagttgtttatgtcggaagatcaaagaatctaaaaaaacgagctgctgttcataaaaagaatcatccagatacgcgaatggttaagaaaagaggaggattaacttatgctcaagcaagaggcttagagcatcggtattatttaaagtatggaggcaagaaaaaacttcgaaataaaatcaggccaataagtcgtaaaaataaaaaatataaatattatatgagttcttcaagaaaattttataaatag

SEQ ID NO: 9 - DNA, 603 bp, Bacillus amyloliquefaciens
gacgaagaaaccggcctgtactatctcatggcccgctactacgagccaagaaacggcgtattcttatcactagacccagacccgggcagcgacggagattctttagatcagaatggatatgcatacggaaacaacaacccggtgatgaacgtcgatcctgacgggcattgggtgtggcttgtggtaaatgccggatttgcagcctatgatggatataaggcctataaatcaggtaaaggatggagaggtgcagcctgggcagcggcttcgaactttggtcctgggaagttatttaagggtgctaaaagggtttataaagcggttcattctgtctatgttttaaaaaaaggaaagaaagttgtttatgtcggaagatcaaagaatctaaaaaaacgagctgctgttcataaaaagaatcatccagatacgcgaatggttaagaaaagaggaggattaacttatgctcaagcaagaggcttagagcatcggtattatttaaagtatggaggcaagaaaaaacttcgaaataaaatcaggccaataagtcgtaaaaataaaaaatataaatattatatgagttcttcaagaaaattttataaatag

SEQ ID NO: 10 - DNA, 603 bp, Bacillus amyloliquefaciens
gacgaagaaaccggcctgtactatctcatggcccgctactacgagccaagaaacggcgtattcttatcactagacccagacccgggcagtgacggcgattctttagatcagaatggatatgcatacggaaacaacaacccggtgatgaacgtcgatcctgacgggcattgggtgtggcttgtggtaaatgccggatttgcagcctatgatggatataaagcatataaatcaggtaaaggatggagaggtgcagcctgggcagcggcttcgaactttggtcctgggaagttatttaagggtgctagtcgggcttataaagcggttcattctgtctatgttttaaaaaaaggaaagaaagttgtttatgtcggaagatcaaagaatctaaaaaaacgagccgctgttcacaaaaaaaaccatccagatacgcgaatggttaagaaaagaggaggattaacttatgctcaagcaaggggcttagagcatcggtattacttaaagtatggaggtaagaaaaaacttcgaaataaaatcagaccaataagtcgtaaaaataaaaaatataagtattatatgagttcttcaagaagattttataagtag

SEQ ID NO: 11 - DNA, 603 bp, Bacillus amyloliquefaciens
tactacgaaccaagaaacggtgtattcttatcactagacccagacccgggaagtgacggcgattctttagatcagaatggatatgcatacggaaacaacaacccagtgatgaatgttgatccagatgggcattgggtgtggcttgtggtaaatgccggatttgcagcctatgatggatataaggcctataaatcaggtaaagggtggagaggtgcagcctgggcagcggcttcgaactttggtcctgggaagttatttaagggtgctagtcgggtttataaagctacccaacaaatgagtaggagggcttcattcagggctgctaaacgggctgccggaatacctacttcttctcaatataaaacacataaaaaagtatacgatggtagtagcgagcatagaactgtatattcttttggtagagttggaagaggaagtcataaaaaatatgtggtacttcataaacatgataaacgaggtagagggccccattttcatggtgttggaaaaggtagaagtcccttgaaaaaagggaggtacaatcaacttaaaggacattatccagaacattttaaaggatatagaacaaaaagaaggagatag

SEQ ID NO: 12 - DNA, 603 bp, Bacillus amyloliquefaciens
accggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaaaagggtttataagtttgcgagcagttccagaaaagtaaagcaaattgactggaaacatataaagaagggtcactcacctaaatctaaaatccctaataaaggaaaattcaagagcaatagagcaatgaaaagaacgaccagacacacattaaaaagaggaaaagctagaccaggtcattcaggtgctactgtatacgaaaaaaaatttaaaaggtatgttggaataaatagtagggggaagaagacaaaaagggttagagtggttgttcagccgaatgggaaactgagaacaagttttccgtactga

SEQ ID NO: 13 - DNA, 603 bp, Bacillus amyloliquefaciens
tactacgagccaagaaacggcgtattcttatcactcgatccagacccgggaagcgacggagattcgctggatcagaatggatatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagccgcttcgaactttggtcctgggaagttatttaagggtgctagtcgggtttataaagctacccaacaaatgagtaggagggcttcattcagggctgctaaacgggctgccggaatacctacttcttctcaatataaaacacataaaaaagtatacgatggtagtagcgagcatagaactgtatattcttttggtagagttggaagaggaagtcataaaaaatatgtggtacttcataaacatgataaacgaggtagagggccccattttcatggtgttggaaaaggtagaagtcccttgaaaaaagggaggtacaatcaacttaaaggacactatccagaacattttaaaggatatagaacaaaaagaaggagatag

SEQ ID NO: 14 - DNA, 603 bp, Bacillus amyloliquefaciens
accggcctgtactatctcatggcccgctactacgaaccaagaaacggtgtattcttatcactagacccagacccgggaagtgacggcgattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaaaagggtttataagtttgcgagcagttccagaaaagtaaagcaaattgactggaaacatataaagaagggtcacgcacctaaatctaaaatccctaataaaggaaaattcaagagcaatagagcaatgaaaagaacgaccagacacacattaaaaagaggaaaagctagaccaggtcattcaggtgctactgtatacgaaaaaaaatttaaaaggtatgttggaataaatagtagggggaagaagacaaaaagggttagagtggttgttcagccgaatgggaaactgagaacaagttttccgtactga

SEQ ID NO: 15 - DNA, 603 bp, Bacillus amyloliquefaciens
ggcctgtactatctcatggcccgctactacgagccaagaaacggcgtattcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcggcttcgaactttggtcctgggaagttatttaagggtgctaaaagggtttataggtttgtaaaatctggtaaaaacttcaattggaaacatatcaaaaaagatcatggacctaagtcaaaagcccgaatgccaaatggccaaccgaaaagcaagtttagaagtgctaaaactcttagaagaacaacaaaggcaacagctagaactaaacctgcatacactcagaaagatggtaggacagtacattataaaaagtttaaaaagcctataggaagaaaaacgaatggtcggcatacttatactgtaaaggttgttaagtccggaaggtatgttgtaacaagctatccttattga

SEQ ID NO: 16 - DNA, 603 bp, Bacillus amyloliquefaciens
atggcccgctactacgagccaagaaacggcgtattcttatcactagacccagacccgggcagtgacggcgattctttagatcagaatggatatgcatacggaaacaacaacccggtgatgaacgtcgatcctgacgggcattgggtgtggatggtagcaggagctttaattggcggaatttcatcttataaagcagcaaaagcaaagggggcaagaggttggaggttagttggatctgtagccttaggtgctgctggcggagcaatcgggggaaactatctacgagtaggacgtactctatataaggctggaaaattatctaaaacgtattggaacgctagaaaagttgcaaaagcaaacaaaggtgtaattaaaagagctagaaataagaaaggttgggtagttactactaaaaaacatacagtaagattaatgggaaggaattcaggacaaaggaaaagaccttattatcgaatgagtcatcataaaaaaggggccatgaacgcaaagggacactattcaaataaacaagctgagactcatattaaattaagatggcattcatatagaaatatcaataaaagattacgtaaggggagataa

SEQ ID NO: 17 - DNA, 603 bp, Bacillus amyloliquefaciens
gacgaagtaaatgacaaccgctaccgctacgcaggctaccaatacgacgaagaaaccggcctgtactatctcatggcccgctactatgagccaagaaacggcgtattcttatcactcgatccagacccgggaagtgacggcgattcattggatcagaatggatatacttatgccaataacaatccggtgatgaaggtcgacccagatgggcactgggccagaattctatgggaagtaataaaaaggtcatggaatggtgctccaggaaagtgggcaaagaggaatgttggtaaggcatataatgcatcaaagaaatggactaaatcagttattaaaaaaggcgcaaaaaaaatcgcgaaaaggattccatatagaattcataaagtaggccgtataaaaggggatagagaaaaaggaagaggttattggggaataatctattcgagaaagaaaaagactgggaggtctatatatagatctctagagtggcatacaccacataataatcatggttatcatttacaaagtaataagttttctatatataaagggaaatggaaaaggggcagtgcacaatggcggtttacagtgtataaaagatag

SEQ ID NO: 18 - DNA, 603 bp, Bacillus amyloliquefaciens
gacgaagtaaaagacaaccgctaccgctacgcaggctaccaatacgacgaagaaaccggcctgtactatctcatggcccgctactacgagccaagaaacggcgtattcttatcactagacccagacccgggcagtgatggggattctttagatcagaatgggtatacttatgccaataacaatccggtgatgaaggtcgacccagatgggcattgggccagaattctatgggaagtaataaaaaggtcatggaatggtgctccaggaaagtgggcaaagaggaatgttggtaaggcatataatgcatcaaagaaatggactaaatcagttattaaaaaaggcgcaaaaaaaatcgcgaaaaggattccatatagaattcataaagtaggccgtataaaaggggatagagaaaaaggaagaggttattggggaataatctattcgagaaagaaaaagactgggaggtctatatatagatctctagagtggcatacaccacataataatcatggttatcatttacaaagtaataagttttctatatataaagggaaatggaaaaggggcagtgcacaatggcggtttacagtgtataaaagatag

SEQ ID NO: 19 - DNA, 603 bp, Bacillus amyloliquefaciens
ttcttatcactagacccagacccgggcagcgacggcgattctttagatcagaatggatatgcatacggaaacaacaacccagtcatgaacgtcgatcctgacgggcattgggtgtggcttgtggtaaatgccggatttgcagcctatgatggatataaggcatataaatcaggtaaaggatggagaggtgcagcctgggcagccgcttcgaactttggtcctgggaagttatttaagggtgctagtcgggtttataaagcggttaaaagttacaaatttgttcgaaaagcaaaaggtggtacgtataagggaaggcttaaaagtaaatattcaaagaagcgttttgtacccgatagttattggagtagaaaagcttcccattttggtacaccgaatagccgtattacccattatagattatataaaggcaggaaggagagatcgactgtaatatatgataaatatgggcgtcaaaagtatcgcatagatcactcgaatcatggtatgcctagagcgcattctaaaccacaccttcacgaatatcattttggaagaggttatgggccaaaaggaaaaaataaaactcataatttttggagatga

SEQ ID NO: 20 - protein, 197 aa, Bacillus amyloliquefaciens
MNHYFIDHPKELKVYQSIINSLFHVEQTLPKQVFKQRKNYYLFEEFHWVLSEESWGMFKSLANEHHDEFILMAVIDSSEDTNQFYEEFEYFNWIKIPLHITADEYLSILTDYPKHSKSDCIMNIASRVVWASPTLKWAIYGERELEICILGIDHQSEGKELATWRSLDDVVLDWISVVFPNQTVPVEFEKTLTAHYK

SEQ ID NO: 21 - protein, 197 aa, Bacillus amyloliquefaciens
MNHYFIDHPKELKVYQSIINSLCHVDQTLPKQVFKQRKNYYLFEEFHWVLSEESWGMFKSLANEHHDEFILMAVIDSSEHINQFYEEFEYFNWIKIPLHITADEYLSLLTDYPKHSKSDCIMNIASRVVWASPTLKWAIYGERELEICILGIDHQSEGKELATWRSLDGVVLDWISVVFPNQTVPVEFEKTLMAHYK

SEQ ID NO: 22 - protein, 197 aa, Bacillus amyloliquefaciens; identical to SEQ ID NO: 21

SEQ ID NO: 23 - protein, 231 aa, Bacillus amyloliquefaciens
MLGGKKEAILALLNDSFNKEEFPFLDNENFDFAKGKLSIFIERDNWLLTFQLFGLSRLGPAIDFYAVGNQLTNNEVSFLDDEPFLFADEKGNLLELEDIESGFTSKQINVSLREKTFQFFIEQEIKDKISPKNEWITCLRHMTKNRLFLDTLWLTKQEQLEIAGLSSEYEQLYSTELWMHPEGEKDLPSLSPFFQSIAEAISRQEIAYIQKHDDGNTEWPKWAHTDSVQYF

SEQ ID NO: 24 - protein, 252 aa, Bacillus amyloliquefaciens
MGYWEEEYKNKKVLLSDEGLDICFDAVEKFCERYKRDLGREPILEEFLATLVTVMNTNGDSSFTELVDKRIVEIKATTRKAKSIAKVVPGAVIQIPLDKIGKYTYAWVIEGDLSKNKDDDILIQYYNIFTENTLSREEVIRLMKEENKKIFAANTGHTGFLQGDWKVISKMPQEMIEKNSHSQLKFVLYEDGKYLVSEGDSFASEDELAEADEKTGKDIPNPLGIFGHSSVESILYKYFEGMTMEEIIKNEL

SEQ ID NO: 25 - protein, 252 aa, Bacillus amyloliquefaciens
MGYWEEEYKNKKVLLSDEGLDICFDAVEKFCELYKRELDREPILEEFLATLVTVMNTNGDSSFTELVDKRIVEIKPTTRKVKPIAKVTPGAVIQIPLDKIGKYTYAWVIEGDLSKNKDDDILIQYYNIFTENTLSREEIIRLMKEENKKIFAANTGHTGFLQGDWKVISKMPQEIIEKNSHSQLKFVLYEDGKYLVSEGDSFASEDELAEADEITGKDIPNPLGIFGHSSVESILYKYFEGMTMEEIIKNEL

SEQ ID NO: 26 - protein, 160 aa, Bacillus amyloliquefaciens
MRRKLDEKLKENKRKILIKQLKERLQYCEKKGFVYQLADVEQSRNLLEAVLSNSIEGMLREVKVNNKKEAEQLLKETTACLGSESKNNIIYLFHPHSDEVGAIKSTLKDCVEHLGCLLDFIEFEGQLLSNSFILLEPSFAFAICLFHTEYGCELFYAKKQ

SEQ ID NO: 27 - protein, 160 aa, Bacillus amyloliquefaciens
MRRKLDEKLKENKRKILIKQLKERLQYCEKKGFVYQLADVEQSRDLLEAVLSNSIEGMLREVKVNNKKEAEQLLKETTASLGSESKNNIIYLFHPHSDEVGAIKSTLKDCVEHLGCLLDFIEFEGQLLSNSFILLEPSFAFAICLFHTEYGCELFYAKKQ

SEQ ID NO: 28 - protein, 275 aa, Bacillus amyloliquefaciens
MLELTAKRVGSYKREHIIYFNTGRDDQVFIVSVHDHKVILEVMKGSSLLIKKELHGFSEDAHFYLVDSYDDTIVIVYLENHTCQLAVYCVNSNKINPICSFLLSANVFHLGEDGLLWIGLTDEGMYDERNPQGKAIFAFHAEDRTFYFKDDFKEMMHECYAIQSIKSDLYVCFEGEDCCVIGHYQIGRDRIRTVAEYVLNGDQYSYCDQLSVSKNRVLLIQNHEDNLFAFHEESKGLSEADVMIHGIDRKGKTTYRAVQDRMFIFHDNDLYLVKF

SEQ ID NO: 29 - protein, 272 aa, Bacillus amyloliquefaciens
MLELTAERVGSYERENIIYFNAGRDDQVFIVSVHDHKVILEVMKGSSLLIKKELHGFSEDAHFYLVDSYDDTIVIVYLENHTCQLAVYCVNSNKINPICSFLLSANVFHLGEDGLLWIGLTDEGMYDERNPQGKAIFAFHAEDRTFYFKDDFKEMMHECYAIQSIKSDLYVCFEGEDCCVIGHYQIGRDRIRTVAEYVLNGDQYSYCDQLSVSKKRVLLIQSHDDTLFAFHEEHKETDVMIHGIDRKGETTYRAVQDRMFIFSDNDLYLVKY

SEQ ID NO: 30 - protein, 290 aa, Bacillus amyloliquefaciens
MDELKFRDLNVKVNEEDSVLLTLTESEIIVLTKKEIDYGNKYINQIDLYCNTNGQFLNSFSIQTNEQVINVQKVSDTFLLLIDKEYEDGVRNVDPNIYLWSPLKGFYQSFYAGRYVNSMIIDQNKNLWVGYDEAGIFSCVDSELSTKGINKFVFKNGLYELCARDVNPYIVDQYYSTFVDKDAIYLYYRSMSENYLQKLNFLGETLERIEIEIECASCVISETSSYFFIRDEDSYNIEIALKTNNMQSYTKQIIMDENTAESISFTHVASYKDKCAGIDINNNLFLLSSF

SEQ ID NO: 31 - protein, 135 aa, Bacillus amyloliquefaciens
MYKTINEWVDYIDGGCAVLHFDFQVFKKELSLKIQVVENKAEYTHNILFQNVASVYFSADIGDMRLEKIDPEEYNWQVFEMSYHPEGIGNLSNAVIPEYQSNANFLIDMNRMLIAIEAETVRFDDQSFYAYHSKS

SEQ ID NO: 32 - protein, 148 aa, Bacillus amyloliquefaciens
MYYFYEISTLNDYDWVEKEYKTIEDLIFVILKNMENKQYAMYSYSVSNKDSDTCIFSASLKTNTLFNKKISFIKTSAEEYKNTIIAHENIILLEKDVELKDILNGAPLAEKTIIKDLLDYVLYHIEITDSETIRIGSRHRENIINIIK

SEQ ID NO: 33 - protein, 148 aa, Bacillus amyloliquefaciens
MYYFYEISTLNDYDWVEKEYKTIEDLIFVILKNMENKQYAMYSYSLSNKDSDTCIFSASLKTNTLFNKKISFMKTSAEEYKNTIVAHENIILLEKDVELKDILNGAPLAEKTIIKDLLDYVLYHIEITDSETIRIGSSYRENIINIIK

SEQ ID NO: 34 - protein, 125 aa, Bacillus amyloliquefaciens
MDWYLDEKIEKKIKDFQITNLKQVTNFNYYREYNDFYDVISSIELTLLYEYLKEEYQIKLKFENVSSVELTNLDYGHQDSYLSINIERINNSWEKIKYIVEDYEEQSFRFYCENYKVIGVENTNN

SEQ ID NO: 35 - DNA, 594 bp, Bacillus amyloliquefaciens
atgaatcactattttattgatcatcctaaggagttaaaagtctatcaatccataattaattccttatttcacgtagagcaaacattgcctaaacaagtttttaaacaaaggaaaaattattatttattcgaggaattccattgggtattatctgaagaaagttggggaatgtttaagagtttggctaatgagcatcatgatgagtttatattaatggctgttatagatagttctgaagatacaaaccaattttacgaagaatttgagtattttaactggataaagatccctttgcatataactgcagatgagtatctgtcaatcttaactgattatccaaagcacagtaaaagtgactgtataatgaatattgcatctcgtgttgtttgggcttcaccgactttaaagtgggcgatttatggtgagagagaacttgaaatctgtattctaggtattgatcatcagagtgaaggaaaagaactagcaacttggagatcgttagatgacgttgtcttagattggatatcagttgtattcccaaaccagacggttccagttgaatttgaaaaaacacttacggcacattacaaataa

SEQ ID NO: 36 - DNA, 594 bp, Bacillus amyloliquefaciens
atgaatcactattttattgatcatcctaaggagttaaaagtctatcaatccataattaattccttatgtcacgtagatcaaacattgcctaaacaagtttttaagcaaaggaaaaattattatttattcgaggaattccattgggtattatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgttgtttgggcttcaccgactttaaagtgggcgatttatggtgagagagaacttgaaatttgtattctaggtattgatcatcagagtgaaggaaaagaactagcaacttggagatcgttagatggcgttgtcttagattggatatcagttgtattcccaaatcagacggttccagttgaatttgaaaaaacacttatggcacattacaaataa

SEQ ID NO: 37 - DNA, 594 bp, Bacillus amyloliquefaciens
atgaatcactattttattgatcatcctaaggagttaaaagtctatcaatccataattaattccttatgtcacgtagatcaaacattgcctaaacaagtttttaagcaaaggaaaaattattatttattcgaggaattccattgggtattatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgttgtttgggcttcaccgactttaaagtgggcgatttatggtgagagagaacttgaaatctgtattctaggtattgatcatcagagtgaaggaaaagaactagcaacttggagatcgttagatggcgttgtcttagattggatatcagttgtattcccaaatcagacggttccagttgaatttgaaaaaacacttatggcacattacaaataa

SEQ ID NO: 38 - DNA, 696 bp, Bacillus amyloliquefaciens
atgttgggtggaaaaaaagaagccattctcgcattgcttaacgattcattcaataaggaagagtttccgtttcttgataatgagaattttgacttcgcaaaagggaagctttcgatttttattgaaagagataactggcttttaacgttccagctgtttggattgtcgagattgggaccagctattgatttttatgcggtgggtaatcaattaacaaataatgaagtaagttttttagatgatgaaccgtttttatttgcagatgaaaaaggaaatttgctggaattggaagatatagaatcgggttttacaagtaaacaaatcaatgtgtctcttagagagaaaacatttcaattttttattgagcaggaaataaaagataagatttccccaaagaatgaatggattacatgtttgaggcatatgaccaaaaatagattatttcttgacacactttggctgacgaaacaagaacaactggaaatagcgggtctctcttcggagtatgaacaattgtattcaacagaattatggatgcatccagaaggagaaaaagatttgcctagtttgtctcctttctttcaatcaattgccgaagcaatttcccgtcaagagatagcatatattcaaaaacatgatgatggtaacacagagtggccaaaatgggcacacacagattctgttcaatacttttga

SEQ ID NO: 39 - DNA, 759 bp, Bacillus amyloliquefaciens
ttgggatattgggaagaagaatataaaaacaagaaagttttacttagtgatgaaggcttagatatatgttttgatgctgtagaaaaattttgtgaacgatataagagagatctgggcagagaaccgatattagaagaattcttagcaactttagttaccgtaatgaatacaaatggagattcttctttcacggagttagttgataagcgaatagtagaaataaaggcaacaaccaggaaagcgaaatcaatagctaaagtagtaccgggagctgttattcaaatacctttggataagatcgggaagtatacttatgcttgggtcattgaaggtgatctatcaaaaaacaaagacgatgacattcttattcagtattataatattttcactgaaaatacacttagcagagaagaagtcattcgtctaatgaaagaagaaaataagaaaatatttgcggctaatactgggcacacaggttttctgcaaggagattggaaagtaatttccaagatgcctcaagagatgatagagaaaaacagtcattctcaattaaaatttgttttatatgaagacggtaaatatctcgtgagtgaaggcgattcatttgcatcagaagatgaattagcagaggcagatgagaaaacaggcaaggacatcccaaacccattaggtatatttggacattcatctgtagaatctattctctataaatattttgaagggatgacaatggaggaaatcataaagaatgaattgtaa

SEQ ID NO: 40 - DNA, 759 bp, Bacillus amyloliquefaciens
ttgggatattgggaagaagaatataaaaacaagaaagttttacttagtgatgaaggcttagatatatgttttgatgctgtagagaaattttgtgaattatataagagggagctggatagagaaccgatattagaagaattcttagcaactttagttaccgtaatgaatacaaatggagattcttctttcacagagttagttgataagcgaatagtagaaataaagccaacgaccaggaaagtgaaaccaatagctaaagtaacaccgggagctgttattcaaatacctttggataagatcgggaagtatacttatgcttgggtcattgaaggtgatctatcaaaaaataaagacgatgacattcttattcagtattataatattttcactgaaaatacacttagcagagaagaaatcattcgtctaatgaaagaagaaaataagaaaatatttgcggctaataccgggcacacaggttttctgcaaggagattggaaagtaatatccaagatgcctcaagagataatagagaaaaacagtcattctcaattaaaatttgttttatatgaagacggtaaatatctcgtgagtgaaggcgattcatttgcatcagaagatgaattagcagaggcagatgagataacaggcaaggacatccctaacccattgggtatatttggacattcatctgtagaatctattctatataaatattttgaagggatgacaatggaggaaatcataaagaatgaattgtaa

SEQ ID NO: 41 - DNA, 483 bp, Bacillus amyloliquefaciens
ttgagaagaaaattagatgaaaaacttaaggagaataagaggaaaattttaataaaacaattaaaagagagattacaatactgcgaaaaaaaggggtttgtttaccaacttgccgatgtagagcaaagccgcaatttgttggaggctgtgttatcaaattctatcgaaggtatgttgcgtgaagtgaaggtgaataacaaaaaggaggctgaacagttattaaaagaaaccaccgcctgcttgggttctgagagcaaaaataatattatctacctatttcatccacatagtgatgaagtgggagccatcaagagtactctgaaagattgtgtagagcatctaggctgtttattagattttattgaatttgaaggtcaattactttctaatagctttattttgctagaaccatcctttgcatttgcaatctgtttatttcacacagaatatggttgtgagctcttttatgcaaaaaaacagtaa

SEQ ID NO: 42 - DNA, 483 bp, Bacillus amyloliquefaciens
ttgagaagaaaattagatgaaaaacttaaggagaataagaggaaaattttaataaaacaattaaaagagagattacaatactgcgaaaaaaaggggtttgtttaccaacttgccgatgtagagcaaagccgcgatttgttggaggctgtgttatcaaattctatcgaaggtatgttgcgtgaagtgaaggtgaataacaaaaaggaggctgaacagttattaaaagaaaccaccgccagcttgggttctgagagcaaaaataatattatctacctatttcatccacatagtgatgaagtgggagccatcaagagtactctgaaagattgtgtagagcatctaggctgtttattagattttattgaatttgaaggtcaattactttctaatagctttattttgctagaaccatcctttgcatttgcaatctgtttatttcacacagaatatggttgtgagctcttttatgcaaaaaaacagtaa

SEQ ID NO: 43 - DNA, 828 bp, Bacillus amyloliquefaciens
atgttagaacttaccgcgaagcgggttgggtcatataaaagagagcacatcatttatttcaatacgggtcgggatgatcaagtatttattgtgtcggtgcatgatcacaaagtaatattggaggttatgaaaggcagctctcttttaatcaaaaaagagttacacggattttctgaagatgcccatttctatctggttgattcgtatgatgacactatcgtgatcgtttacctggaaaatcatacgtgtcaattagctgtatactgcgtaaacagtaataaaatcaatccgatttgttcttttctattaagcgccaatgtatttcatctgggtgaggatggattactatggatcggattaacagacgagggtatgtatgatgagagaaaccctcaagggaaagcgatatttgcttttcatgcagaagacagaacgttttattttaaagacgattttaaagaaatgatgcacgaatgctatgccatacaatcgatcaaatctgatttgtatgtatgttttgagggagaggattgctgtgtcatcggtcattatcagattggacgggacagaattcgtactgttgcagaatatgtgctaaacggcgatcaatactcctattgtgaccagctgtccgtttcgaaaaatagggtgctgctgatacagaatcacgaggataacctatttgcatttcatgaagagagcaaagggttatcagaggctgacgtcatgatacacggtattgatagaaaaggaaaaacaacgtacagagccgtccaggaccgcatgtttatctttcatgataacgatttatatctggtaaagttttga

SEQ ID NO: 44 - DNA, 819 bp, Bacillus amyloliquefaciens
atgttagaacttaccgcggagcgtgttgggtcatatgaaagggaaaatatcatttatttcaatgcgggtcgggatgatcaagtatttattgtgtcggtgcatgatcacaaagtaatattggaggttatgaaaggcagctctcttttaatcaaaaaagagttacacggattttctgaagatgcccatttctatctggttgattcgtatgatgacactatcgtgatcgtttacctggaaaatcatacgtgtcaattagctgtatactgcgtaaacagtaataaaatcaatccgatttgttcttttctattaagcgccaatgtatttcatctgggtgaggatggattactatggatcggattaacagacgagggtatgtatgatgagagaaaccctcaagggaaagcgatatttgcttttcatgcagaagacagaacgttttattttaaagacgattttaaagaaatgatgcacgaatgctacgccatacaatcgatcaaatctgatttgtatgtatgttttgagggagaggattgctgtgtcatcggtcattatcagattggacgggacagaattcgtactgttgcagaatatgtgctaaacggcgatcaatactcctattgtgatcagctatccgtttcgaaaaaaagggtgctgctgattcagagtcacgatgataccctatttgcatttcatgaagagcacaaagagactgacgtcatgatacacggtattgatagaaaaggagaaacaacgtacagagccgtacaggatcgcatgtttatctttagtgataacgatttatatctggtgaagtattga

SEQ ID NO: 45 - DNA, 873 bp, Bacillus amyloliquefaciens
atggatgaattaaaatttagagatttgaatgtaaaagtaaatgaggaagactcagttctgctaacgttgactgaatcagaaataattgtcctaacaaaaaaagaaattgattatggcaacaaatatattaatcaaattgatctgtattgtaatacgaatggacaattcctgaatagctttagcatacaaacaaatgaacaagttataaacgtgcaaaaagttagcgatacttttttacttttaatagataaagagtacgaggacggagttcgaaatgttgatcccaacatatatttgtggagtccacttaaaggtttctaccaatctttttatgctggaagatacgttaattcaatgataatagatcaaaataagaatctatgggtcggatatgatgaagcgggcatattttcttgcgttgattccgaattaagcacgaaaggaattaataaattcgtttttaaaaatggactatatgaattatgtgctcgtgacgttaatccatatattgttgaccagtactattctacatttgtagataaagatgcaatctatttgtattacagatcaatgagtgaaaattacttgcaaaaattaaactttcttggagaaacattggaacgaattgagattgaaatagagtgtgcttcatgcgtaatatccgaaacatctagttattttttcattcgtgatgaggattcttataatattgagatagctctgaagacaaataatatgcaaagctatacaaaacaaataataatggatgagaatactgcagaaagtatcagttttacacatgtagcatcatataaagataaatgtgcagggattgatattaacaacaacctttttctgttaagtagtttctga

SEQ ID NO: 46 - DNA, 408 bp, Bacillus amyloliquefaciens
atgtacaaaacaataaatgaatgggtagattacatagatggggggtgcgctgtccttcattttgattttcaagtgtttaaaaaagaactttcacttaagattcaggtcgttgaaaataaagccgaatatacgcataacattctttttcaaaatgtagcatctgtttattttagtgcagatattggtgatatgagattagaaaaaatagatcctgaagaatacaattggcaagtatttgagatgagttaccacccggaaggaatcggtaatctatcaaatgctgtaattccggagtatcaatcaaatgctaattttctcattgacatgaacagaatgctgattgctatagaagctgaaacagttcgctttgatgatcaatcattttatgcgtatcattcgaaatcataa

SEQ ID NO: 47 - DNA, 447 bp, Bacillus amyloliquefaciens
atgtactatttttatgaaatatcaactctcaatgactatgattgggttgaaaaagagtataaaacaatagaggatttaatatttgttatattaaaaaatatggaaaataaacaatacgcaatgtattcttactctgtttcaaataaagatagtgatacttgtatattctcagcgagcttaaaaacaaatactttgtttaataaaaaaatctcatttataaaaacctcagcagaagagtacaagaatacaataattgcgcatgaaaatataatcttattggaaaaagatgttgagttaaaagatatattaaatggagcccctttagcagagaaaacaattattaaagatttactggattatgttctttatcatatagaaataacagattccgagacaatcagaataggatctagacatagagaaaatattataaacattattaaataa

SEQ ID NO: 48 - DNA, 447 bp, Bacillus amyloliquefaciens
atgtactatttttatgaaatatcaactctcaatgactatgattgggttgaaaaagagtataaaacaatagaggatttaatatttgttatattaaaaaatatggaaaataaacaatatgcaatgtattcttactctctttcaaataaagatagtgatacttgtatattctcagcgagcttaaaaacaaatactttgtttaataaaaaaatctcttttatgaaaacctcagcagaagagtacaaaaatacaatagttgcgcatgaaaatataatcttattggaaaaagatgttgagttaaaagatatattaaatggagctcctttagcagagaaaacaattattaaagatttactggattatgttctttatcatatagaaataacagattccgagacaatcagaataggatctagttatagagaaaatattataaacattattaaataa

SEQ ID NO: 49 - DNA, 378 bp, Bacillus amyloliquefaciens
atggattggtatttagatgaaaaaatagaaaagaaaataaaggattttcaaataactaacttaaaacaagttactaattttaattattatagagaatataatgacttttatgacgtaattagttcaatagagttaactctattgtacgaatatttaaaggaagaatatcaaataaagttaaaatttgagaatgtatcatctgtagagttaactaacttggattatggtcatcaagattcttatttaagtattaacatagaaagaattaacaatagttgggaaaaaataaaatatatagtagaagattatgaagaacaatcttttagattttattgtgagaattataaagtaattggtgttgaaaatacgaataattaa

SEQ ID NO: 50 - protein, 200 aa, Bacillus amyloliquefaciens
MARYYEPRNGVFLSLDPDPGSDGDSLDQNGYAYGNNNPVMNVDPDGHWVWLVVNAGFAAYDGYKAYKSGKGWRGAAWAAASNFGPGKIFKGASRIYKAAKTYKLSRKSVRARRAYSSYRDITGKTSRFKNYSTNVRRRTFEKNLRRQGWRKSVHHGGVITMTKNGNKYSLRKHAKSSPYPTAEYTPKGRKKFTHKIRMRH

SEQ ID NO: 51 - protein, 200 aa, Bacillus amyloliquefaciens
MARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRIYKAAKTYKLSRKSVRARRAYSSYRDITGKTSRFKNYSTNVRRRTFEKNLRRQGWRKSVHHGGVITMTKNGNKYSLRKHAKSSPYPTAEYTPKGRKKFTHKIRMRH

SEQ ID NO: 52 - protein, 200 aa, Bacillus amyloliquefaciens
MARYYEPRNGVFLSLDPDPGSDGDSLDQNGYTYGNNNPVMNVDPDGHWVWLVVNAGFAAYDGYKAYKSGKGWRGAAWAAASNFGPGKLFKGANRIYKAAKTYKLSRKSVRARRAYSSYRDITGKTSRFKNYSTNVKRRTFEKNLRRQGWRKSVHHGGVITMTKNGNKYSLRKHAKSSPYPTAEYTPKGRKKFTHKIRMRH

SEQ ID NO: 53 - protein, 200 aa, Bacillus amyloliquefaciens
MARYYEPRNGVFLSLDPDPGSDGDSLDQNGYAYGNNNPVMNVDPDGHWVWLAINAGFAAYDGYKAYKSGKGWRGAAWAAASNFGPGKLFKGANRIYKAAKTYKLSRKSVRARRAYSSYRDITGKTSRFKNYSTNVKRRTFEKNLRRQGWRKSVHHGGVITMTKNGNKYSLRKHAKSSPYPTAEYTPKGRKKFTHKIRMRH

SEQ ID NO: 54 - protein, 200 aa, Bacillus amyloliquefaciens
RYYEPRNGVFLSLDPDPGSDGDSLDQNGYAYGNNNPVMNVDPDGHWVWLVVNAGFAAYDGYKAYKSGKGWRGAAWAAASNFGPGKVFKGAKKALGFAKAAKKYLKPGKYARRSIPARSTSSRLNKKERRVLNKIGNKYGCHTCGRRHPGTKSRNWIADHQPVSKLRKKGQRQRLYPHCQTCSRKQGGYTSAILRKRHQRR

SEQ ID NO: 55 - protein, 200 aa, Bacillus amyloliquefaciens; identical to SEQ ID NO: 54

SEQ ID NO: 56 - protein, 200 aa, Bacillus amyloliquefaciens
DEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGAKRVYKAVHSVYVLKKGKKVVYVGRSKNLKKRAAVHKKNHPDTRMVKKRGGLTYAQARGLEHRYYLKYGGKKKLRNKIRPISRKNKKYKYYMSSSRKFYK

SEQ ID NO: 57 - protein, 200 aa, Bacillus amyloliquefaciens
DEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRAYKAVHSVYVLKKGKKVVYVGRSKNLKKRAAVHKKNHPDTRMVKKRGGLTYAQARGLEHRYYLKYGGKKKLRNKIRPISRKNKKYKYYMSSSRRFYK

SEQ ID NO: 58 - protein, 200 aa, Bacillus amyloliquefaciens
YYEPRNGVFLSLDPDPGSDGDSLDQNGYAYGNNNPVMNVDPDGHWVWLVVNAGFAAYDGYKAYKSGKGWRGAAWAAASNFGPGKLFKGASRVYKATQQMSRRASFRAAKRAAGIPTSSQYKTHKKVYDGSSEHRTVYSFGRVGRGSHKKYVVLHKHDKRGRGPHFHGVGKGRSPLKKGRYNQLKGHYPEHFKGYRTKRRR

SEQ ID NO: 59 - protein, 200 aa, Bacillus amyloliquefaciens
TGLYYLMARYYEPRNGVFLSLDPDPGSDGDSLDQNGYAYGNNNPVMNVDPDGHWVWLAINAGFAAYDGYKAYKSGKGWRGAAWAAASNFGPGKLFKGAKRVYKFASSSRKVKQIDWKHIKKGHSPKSKIPNKGKFKSNRAMKRTTRHTLKRGKARPGHSGATVYEKKFKRYVGINSRGKKTKRVRVVVQPNGKLRTSFPY

SEQ ID NO: 60 - protein, 200 aa, Bacillus amyloliquefaciens
TGLYYLMARYYEPRNGVFLSLDPDPGSDGDSLDQNGYAYGNNNPVMNVDPDGHWVWLAINAGFAAYDGYKAYKSGKGWRGAAWAAASNFGPGKLFKGAKRVYKFASSSRKVKQIDWKHIKKGHAPKSKIPNKGKFKSNRAMKRTTRHTLKRGKARPGHSGATVYEKKFKRYVGINSRGKKTKRVRVVVQPNGKLRTSFPY

SEQ ID NO: 61 - protein, 200 aa, Bacillus amyloliquefaciens
GLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGAKRVYRFVKSGKNFNWKHIKKDHGPKSKARMPNGQPKSKFRSAKTLRRTTKATARTKPAYTQKDGRTVHYKKFKKPIGRKTNGRHTYTVKVVKSGRYVVTSYPY

SEQ ID NO: 62 - protein, 200 aa, Bacillus amyloliquefaciens
MARYYEPRNGVFLSLDPDPGSDGDSLDQNGYAYGNNNPVMNVDPDGHWVWMVAGALIGGISSYKAAKAKGARGWRLVGSVALGAAGGAIGGNYLRVGRTLYKAGKLSKTYWNARKVAKANKGVIKRARNKKGWVVTTKKHTVRLMGRNSGQRKRPYYRMSHHKKGAMNAKGHYSNKQAETHIKLRWHSYRNINKRLRKGR

SEQ ID NO: 63 - protein, 200 aa, Bacillus amyloliquefaciens
DEVNDNRYRYAGYQYDEETGLYYLMARYYEPRNGVFLSLDPDPGSDGDSLDQNGYTYANNNPVMKVDPDGHWARILWEVIKRSWNGAPGKWAKRNVGKAYNASKKWTKSVIKKGAKKIAKRIPYRIHKVGRIKGDREKGRGYWGIIYSRKKKTGRSIYRSLEWHTPHNNHGYHLQSNKFSIYKGKWKRGSAQWRFTVYKR

SEQ ID NO: 64 - protein, 200 aa, Bacillus amyloliquefaciens
DEVKDNRYRYAGYQYDEETGLYYLMARYYEPRNGVFLSLDPDPGSDGDSLDQNGYTYANNNPVMKVDPDGHWARILWEVIKRSWNGAPGKWAKRNVGKAYNASKKWTKSVIKKGAKKIAKRIPYRIHKVGRIKGDREKGRGYWGIIYSRKKKTGRSIYRSLEWHTPHNNHGYHLQSNKFSIYKGKWKRGSAQWRFTVYKR

SEQ ID NO: 65 - protein, 200 aa, Bacillus amyloliquefaciens
FLSLDPDPGSDGDSLDQNGYAYGNNNPVMNVDPDGHWVWLVVNAGFAAYDGYKAYKSGKGWRGAAWAAASNFGPGKLFKGASRVYKAVKSYKFVRKAKGGTYKGRLKSKYSKKRFVPDSYWSRKASHFGTPNSRITHYRLYKGRKERSTVIYDKYGRQKYRIDHSNHGMPRAHSKPHLHEYHFGRGYGPKGKNKTHNFWR

SEQ ID NO: 66 - DNA, 58 bp, Bacillus subtilis
tctagatcgaaagcaaggaggagcagacgtatggccaaaataaaagatgattgtatag

SEQ ID NO: 67 - DNA, 63 bp, Bacillus subtilis
aagcttaaaaaaacgctgtgccctttaaccgcacagcgtttttttttaaggaagtttagaagg

SEQ ID NO: 68 - DNA, 51 bp, Escherichia coli
cgatttatatctggtgaagtattgaaaaaaaacgctgtgcggttaaagggc

SEQ ID NO: 69 - DNA, 46 bp, Escherichia coli
cgctccgcggtaagttctaacatacgtctgctcctccttgctttcg

SEQ ID NO: 70 - DNA, 46 bp, Bacillus amyloliquefaciens
cgaaagcaaggaggagcagacgtatgttagaacttaccgcggagcg

SEQ ID NO: 71 - DNA, 51 bp, Bacillus amyloliquefaciens
gccctttaaccgcacagcgttttttttcaatacttcaccagatataaatcg

SEQ ID NO: 72 - DNA, 7032 bp, Bacillus amyloliquefaciens
atgaaaataggaaaaaagaacaagtggaaaaaatggctggccggcactcttgcggcaacgctgatgatttccattgcgcctgccgatgtgtttgcggcagaaacgcgtgaaaaacaagatcaagcgaaaaccgccgccattccggccgcagacccggaaaaagatcttccggcggaaaaagcatctgagcagatgccttttgatcaaaaagatatcaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggagaatacagtgctgaactccgattttctgaagcaaatgaaaaacggattatacgccacatttgaacatgatgatcataagctcacatactcattaaccggcgcaaaaggccccgatcaggctgcaatcactccgacagatgcctcagcaaaagtcaagggagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcagcaggtcagaagatgtcagcttcaagcttgaaaaaaacagtgaaggctacttgcttcatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaacgccggcggcagctatccggcaagtaaaaattactgggtcgcggtcagcgcggtgtttgaccagggagaaggcgccatgtctgcggccgccaagcccgtcattccgaatatcggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagctcaaaacatctggccgacaaaggcggaaatcagcgccggaaaatatgcgcttcacctgaaagacaaaaaaggcgcggaattgccgattaacccgggccccgtttataaaaacgccggcggagatgcaaatcggaaaacttacggatttaaagttatcgcctataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacgcatctggccgtcagctgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacgtcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacctttaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagacgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccggaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgccgtttctgaaacggatcaaagcggaaaatcctcatccgccgccgtgtacgacaaatacggtaatctcattcaatcaagcaaagagctggcagcttcggcaagcctgctgaaagacggcagctttgaaggaacaaagcttggctggaatctcactgctacgagagacagcggaagcatcgcatctgtaaaagcaagaagcggcgcgctgtccggacaaaaagcattggagatctcgtcacaatccgcttcagccggaacagagcacggccatgcgtccgcaacgcaggaagtgcagctagagccgaatacgacgtatacactcagcggccagatcaaaacggatctgacgaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcacggacgataagccggtatatatcacgctgacggggatgtccaaggctgacggcgtaaaattaacgaacgacaatgattacgctcttcaggctgacgtcacttatgcggacggcacgacgggcgtctacaccgccaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccggcgcggaccagacctatcaatatgaatatgacgtcatgggcaagctcgtcaaaacaaccgacccgctcggcaatgtactgaagagtgaatatgacgccaacagtaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacgaacttgatcaaatgattgaaatgaaagacggcacttcagcctatacatttgattatgatgaaaacggcaatgtccagacattcatcagcggaaatgaagtcggcacgagcttctcatatgatgagcggaatctcgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatccttcaacatcatgaatcagctgacgaaggtgaatgacgaagacctgtcctatgataaaaacggcaaccgcacatccgacggcaaattcacatatacgtgggacgcggaagacaacctgaccgccgtaacgaaaaaaggcgaagacaagccgttcgcaacatacaaatatgatgaaaaaggaaacagaatccaaaaaaccgtcaacggaaacgtcacaaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatcacagacagcaccggaaaaaccgttgccaaatatcaatacgatgcatggggaaatccgacaaaaaccgaagcgagcgacgaagtaaatgacaaccgctaccgctacgcaggctaccaatacgacgaagaaaccggcctgtactatctcatggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcagcttcgaactttggtcctgggaaaatatttaagggtgctagtcggatttataaagctgctaaaacatataaactatctagaaaaagtgtacgggctagaagggcctactcaagttatagggatataactggaaaaacctctaggttcaaaaattattctactaatgtaagaagaagaacttttgaaaaaaatttaagaagacaaggatggagaaaatcagttcatcatgggggtgttatcactatgacgaaaaatgggaataagtattccctaaggaaacatgctaagtcaagtccttatccaaccgcggaatatacacctaaaggtagaaaaaaattcacacacaaaatcagaatgcgacattaa

SEQ ID NO: 73 - DNA, 7032 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcacagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatatcggaagagttcagaaaccaagcacgaaaggcgttaataacaacaacgccacaggctggtttgatctttcctggaaagccgtatcaggcgcagccgggtataaaatgcaagtctttaacggcaaaggctttgaaatgcttgacctcggaaataaaacatcctggtccacaaaagatcaaaacatctggccgacaaaggcggaaatcagcgccggaaaatatgcgcttcacctgaaagacaaaaaaggtgcggaattgccgatcaacccaggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgataacgcaaacggcaattacaaagggaagaagaactattccttcacgctgaccgcctatgacgcaaacggtgacagcctaccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagatgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgataaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgacattgcgtacgacggacttgatgccgtttctgaaacggatcaaagcggaaaatcctcatccgccgccgtgtatgacaagtacggaaatctcattcaatcaagcaaagagctggcagcttcggcaagtctgctgaaagacggcagctttgaaggaacaaagctgggctggaatctcaccgctacgagagacagcggaagcatcgcgtctgtcaaaggaagaagcggcgcgctgtccggacaaaaagcattggagatcttgtcacaatccgcttcagccggaacggagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttaatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacagggatgtccaaggctgacggcgtaaaatttacgaacgacaatgattacgcgcttcaggctgacgtcacttatgcggacggcacgacgggcgtctacaccgctaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccgacgcggaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaggtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagtggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcttccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaatgacaaccgctaccgctacgcaggctaccaatacgacgaagaaaccggcctgtactatctcatggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcagcttcgaactttggtcctgggaaaatatttaagggtgctagtcggatttataaagctgctaaaacatataaactatctagaaaaagtgtacgggctagaagggcctactcaagttatagggatataactggaaaaacctctaggttcaaaaattattctactaatgtaagaagaagaacttttgaaaaaaatttaagaagacaaggatggagaaaatcagttcatcatgggggtgttatcactatgacgaaaaatgggaataagtattccctaaggaaacatgctaagtcaagtccttatccaaccgcggaatatacacctaaaggtagaaaaaaattcacacacaaaatcagaatgcgacattaa

SEQ ID NO: 74 - DNA, 7032 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatatcggaagagttcagaaaccaagcacgaaaggcgttaataacaacaacgccacaggctggtttgatctttcctggaaagccgtatcaggcgcagccgggtataaaatgcaagtctttaacggcaaaggctttgaaatgcttgacctcggaaataaaacatcctggtccacaaaagatcaaaacatctggccgacaaaggcggaaatcagcgccggaaaatatgcgcttcacctgaaagacaaaaaaggtgcggaattgccgatcaacccaggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgataacgcaaacggcaattacaaagggaagaagaactattccttcacgctgaccgcctatgacgcaaacggtgacagcctaccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagatgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgataaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgacattgcgtacgacggacttgatgccgtttctgaaacggatcaaagcggaaaatcctcatccgccgccgtgtatgacaagtacggaaatctcattcaatcaagcaaagagctggcagcttcggcaagtctgctgaaagacggcagctttgaaggaacaaagctgggctggaatctcaccgctacgagagacagcggaagcatcgcgtctgtcaaaggaagaagcggcgcgctgtccggacaaaaagcattggagatcttgtcacaatccgcttcagccggaacggagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttaatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacagggatgtccaaggctgacggcgtaaaatttacgaacgacaatgattacgcgcttcaggctgacgtcacttatgcggacggcacgacgggcgtctacaccgctaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccgacgcggaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaggtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagtggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcttccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaatgacaaccgctaccgctacgcaggctaccaatacgacgaagaaaccggcctgtactatctcatggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcagcttcgaactttggtcctgggaaaatatttaagggtgctagtcggatttataaagctgctaaaacatataaactatctagaaaaagtgtacgggctagaagggcctactcaagttatagggatataactggaaaaacctctaggttcaaaaattattctactaatgtaagaagaagaacttttgaaaaaaatttaagaagacaaggatggagaaaatcagttcatcatgggggtgttatcactatgacgaaaaatgggaataagtattccctaaggaaacatgctaagtcaagtccttatccaaccgcggaatatacacctaaaggtagaaaaaaattcacacacaaaatcagaatgcgacattaa

SEQ ID NO: 75 - DNA, 7032 bp, Bacillus amyloliquefaciens
atgaaaataggaaaaaagaacaagtggaaaaaatggctggccggcactcttgcggcaacgctgatgatttccattgcgcctgccgatgtgtttgcggcagaaacgcgtgaaaaacaagatcaagcgaaaaccgccgccattccggccgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggagaatacagtgctgaattccgattttctgaagcaaatgaaaaacggattatacgctacatttgaacacgatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgatcttcaggctaaagaacaggaagacggctcgatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagtgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgcagcatcgcagaaatgggatgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgataacgcaaacggcaattacaaagggaagaagaactattcctttacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagacggcagagccgtttatattgatgaggacgcgacaacacatgtcttcacggaaaaatctgacggcacgtatcagccgccgacgggcgtttatctcgaactgacggaaacaagcgatcaatttgtattaaaaacaaaagatcagacgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttatctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctgaccaaagccgtcaatgcgaaaaaagaaacgtacgactacagctatgacgcggacaaaaaaacgctgctcatgacgcagccgaacggccgcaaagtgcagtacggctataatgaggcgggcaatccgattcagctgattgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacatcactgatattgcgtacgacggactggatgccgtttctgagacggatcaaagcggaaaatcctcatccgccgccgtgtatgacaagtacggaaatctcattcaatcaagcaaagagctggcagcttcggcgagcctgctgaaagacggcagctttgaaggaacaaagcttggctggaatctcactgctacgagagacagcggaagcatcgcgtctgtcaaaggaagaagcggcgcgctgtccggacaaaaagcattggagatcacctcacaatccgcttcagccggaacggagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgttgtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacggggatgtccaaggctgacggcgtaaaattaacgaacgacaatgattacgctcttcaggctgacgtcacttatgcggacggcacgacgggcgtctacaccgccaaattcccgcaggggacacaggaatggaaccgggcagcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggtgcggaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaataaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccaggaaagctatgaatacgacgccaacggcaaccgcacggtcatcgacagctcagcgggcggaaaggtgcagtacgaatacggcaagctcaaccagctcgtcaaagaaactcatgaagacggcactgtcattcaatatacgtacgacggcttcggcaaccggacaaacgtcaccaccacaaaggacggcgcaagcaaatcagtcaacgcttccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacaaagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccagtacgatgaagaaaccggtctatactatctcatggcccgctactacgaaccaagaaacggcgtgttcttatcactcgacccagacccgggaagtgacggcgattctttagatcagaatggatatgcatacggaaacaacaacccggtgatgaacgtcgatcctgacgggcattgggtgtggcttgtggtaaatgccggatttgcagcctatgatggatataaggcctataaatcaggtaaaggatggagaggtgcagcctgggcagcggcttcgaactttggtcctgggaagttatttaagggtgctagtcggatttataaagctgctaaaacatataaactatctagaaaaagtgtacgggctagaagggcctactcaagttatagggatataactggaaaaacctctaggttcaaaaattattctactaatgtaagaagaagaacttttgaaaaaaatttaagaagacaaggatggagaaaatcagttcatcatggaggtgttatcactatgacgaaaaatgggaataagtattccctaaggaaacatgctaagtcaagtccttatccaaccgcggaatatacacctaaaggtagaaaaaaattcacacacaaaatcagaatgcgacattaa

SEQ ID NO: 76 - DNA, 7032 bp, Bacillus amyloliquefaciens
atgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgagaattcaaagctttattatgagggcgaaggtgtatacaaacaggaaatctacacagaccccattcacacgaaagaaaccgccaatgcggactgggaagacgtttcccctgaattgaaaaccggctcaaaggatgtcgggacggaaaatacagtgctgaactccgattttctgaagcaaatgaaaaacggattatacgctacatttgaacatgatgatcataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgacaaagacaatgtcgtctacaccgtgccgaagccttttatgaccgactcagatctcgacgagaagtcaggtgaggtcagcaggtcagaagatgtcagcttcaagcttgaaaaaaacagcgaaggctacttgctgcatgtaacggccgatgaaaaatggctgaaagatcccaagcgggtttatccggtatctattgatccttccacatcagtatccgtgtcatccgatacctttgtcatgagtgcgtacccgacgacaaactactctgccgcgtcgcagaaatgggacgccggattgaaagcgtacgtgctgaaaacaggttattatgacggcacaaccggaacgaactacgcatttatgaagtttgataatctaaagccgatcaaaaacatgacggtgacaaaagcgacgcttaaagcatacacagtccactcctattacggatcaaaggcgacggggctttggctcgacaccgtaaacagcaattacgacaatgccaagatcacgtggaaaaacaagccaggctccaaaaacatcggcaaagccgaggtctataaaggccaatgggcaagcttcgatgtcacatccgcagtcaagtcgtggaacagcggcggcgccaattacggctttaagcttcacgcaaacggcaacggaaaagaatattggaagaagctgatgtcatcagcaaactctaataaaaaaccttatatcgaagtgacatacacgattccgaaggcggacacgccgtcagtcaaagcgtatcataacggagattcgacaggatttttcaatatcagctggaaaaaagctgaaggcgccaaaagctataaagtgtggctttataacgggaaagaatatcaagccatttctgtcggcaatgcaacctcttggagcacaaaaggaaaaaacatctggccgacaaaagcggaaattgattccggtaaatataagctgcatacagacggaaaaggcggaagtgaattagcgcttgacccttccccggtctataaaaactccggcggcagctatccggcaagcaaaaattactgggtcgcggtcagtgcggtgtttgaccagggagaaggcgccatgtctgcggccgccaagcccgtcattccgaatattggaagagttcaaaggccaagcacgaaaggctttaataacaacaacgcaacaggatggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaatgccggcggagacgcaaaccggaaaacatacggatttaaagtaatcgcctataacaaagacggagaagcgatcgcctcaccggaagctagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccgtcagccgatgaagtgaaagcgggaaaattccagcttcacaaggacggaaagggcggcgaactggcgcttgacccttcacctgtttacgaaaacgcaaacggcaattacaaagggaagaagaactattcctttacgctgaccgcctatgacgcaaacggtgacagcataccgacggcaccttttaaccctgttttccatgaaggtgcggaattcctcggaacggaagaattctggtctattatcgacattccggacggacagctgaacggcgcgacgggaaatgtcatcgtcaatgaagaagatatgtcaatcgacggacgcgggccggggctcggactctcccggacctttaacagccttgacagctctgaccatatgttcggccaaggatggtatgccgatgcggaaacgtcgatcctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaaggacgcctcgtcaagcagtattccgcaaacagcacggatgacaaaccgctgttcactgaataccaatacagcggccaccgtctgaccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacatcactgatattgcgtacgacggactggatgccgtttctgaaacggatcaaagcggaaaatcctcatccgccgccgtgtatgacaaatacggtaatctcattcaatcaagcaaagagctggcagcttcggcaagcctgctgaaagacggcagctttgaaggaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacctttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggctaaagcagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatattacgctgacagggatgtccaaggcagacggcgtaaaattaacgaacgacaatgattacgcgcttcaggccggcgtcacttatgcggacggcacgacaggcgtctataccgccaaattcccgcaggggacacaggaatggaaccgggcggcggcagtcattccgaaaacaaagccgatcaataaaatcgaaatcagcattctgttccaaaaaagcgccacgggaacggcgtggtttgatgacatccgtttaattgaaggaagcatcctgacgaaaaacacctatgacgaaaaaggaaactacgtcacaaaagaagaagacgaactagggtatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacgacactgaaaaatacaactttacctatgacaaaaacggcaatgaaacgtcagtcacaaacaaagaacaaaatacaacgaagaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctcccttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaacccatgaagacggcactgtcattcaatatacgtacgacggcttcggcaaccggacaaatgttaccaccacaaaggacggcgcaagcaaatcagtcaacgcatccttcaacatcatgaaccagctgacgaaggtgaatgacgaagacctgtcctacgataaaaacggcaaccgcacatccgacggcaaatacacatatacgtgggacgcggaagacaacctgaacgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgctatctcagacagcaccggaaaaaccgttgccaaataccaatacgatgcatggggaaatccgacaaaaaccgaagcgagcgacgaagtaaaagacaaccgctaccgctacgcaggctaccagtacgatgaagaaaccggcctgtactatctcatggcccgctactatgagccaagaaacggcgtattcttatcactagacccagacccgggcagcgacggagattcgctcgatcagaatgggtatacttatggaaacaacaacccagtcatgaacgtcgatccggatgggcattgggtgtggcttgtggtaaatgccggatttgcagcctatgatggatataaggcatataaatcaggtaaaggatggagaggtgcagcctgggcagcggcttcgaactttgggcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaa

SEQ ID NO: 77 - DNA, 7032 bp, Bacillus amyloliquefaciens
atgaagataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgagaattcaaaactttattatgagggcgaaggtgtatacaaacaggaaatctacacaaaccccattcatacgaaagaaaccgccaatgcggactgggaagacgtttcccctgaattgaaaaccggctcaaaggatgtcgggacggaaaatacagtgctgaactccgattttctgaagcaaatgaaaaacggattatacgctacatttgaacatgatgatcataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgacaaagacaatgtcgtctacaccgtgccgaagccttttatgaccgactcagatctcgacgagaagtcaggtgaggtcagcaggtcagaagatgtcagcttcaagcttgaaaaaaacagcgaaggctacttgctgcatgtaacggccgatgaaaaatggctgaaagatcccaagcgggtttatccggtatctattgatccttccacatcagtatccgtatcatccgatacctttgtcatgagtgcgtacccgacgacaaactactctgccgcgtcgcagaaatgggacgccggattgaaagcgtacgtgctgaaaacaggttattatgacggcacaaccggaacgaactacgcatttatgaagtttgataatctaaagccgatcaaaaacatgacggtgacaaaagcgacgcttaaagcatacacagcccactcctattacggatcaaaggcgacggggctttggctcgacaccgtaaacagcaattacgacaatgccaagatcacgtggaaaaacaagccgggctccaaaaacatcggcaaagccgaggtctataaaggccaatgggcaagcttcgatgtcacatccgcagtcaagtcgtggaacagcggcggcgccaattacggctttaagcttcacacaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtgtggctttataacgggaaagaatatcaggccatttctgtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaacgccggcggcagctatccggcaagtaaaaattactgggtcgcggtcagcgcggtgtttgaccagggagagggcgccatgtctgcggccgccaagcccgtcattccgaatatcggaagagttcagaaaccaagcacgaaaggctttaataacaacaacgtcacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaatgccggcggagacgcaaaccggaaaacatacggatttaaagtaatcgcctataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacacatctggccgtcagccgatgaagtgaaagcgggaaaattccagcttcacacggacggaaagggcggcgaactggcgcttgacccttcacctgtttacgaaaacgcaaacggcaattacaaagggaagaagaactattcctttacgctgaccgcctatgacgcaaatggtgacagtataccgacggcaccttttaaccctgttttccatgaaggtgcggaattcctcggaacggaagaattctggtctattatcgacattccggacggacagctgaacggcgcgacgggaaatgtcatcgtcaatgaagaagatatgtcaatcgacggacgcgggccggggctcggactctcccggacctttaacagccttgacagctctgaccatatgttcggccaaggctggtatgccgatgcggaaacgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggaggacaaaccgctgttcactgaataccaatacagcggccaccgtctgaccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacatcactgatattgcgtacgacggactggatgccgtttctgaaacggatcaaagcggaaaatcctcatccgccgccgtgtatgacaaatacggtaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacatttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggccaaaacagacggatggagcacaagcggaaccgccgctgaccttgatgaaggcttcgatgatgacagctcattaaaagcgtcccgcacaaatgcatcacaagccaatgcggccgcaaaacaaaccattacattaggccaaagcgcggacgataagccggtatatatcacgctgacagggatgtccaaggctgacggcgtaaaattaacgaacgacaatgattacgcgcttcaggccggcgtcacctatgcggacggcacgacaggcgtctacaccgccaaattcccgcaggggacacaggaatggaaccgggcggcggcagtcattccgaaaacaaagccgatcaataaaatcgaaatcagcattctattccaaaaaagcgccacaggaacggcgtggtttgatgacatccgattaatcgaaggaagcatcctgacgaaaaacacctatgacgaaaaaggaaactacgtcacaaaagaagaagacgaactaggttatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcagtcacaaacaaagaacaaaatacaacgaagaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggcaatgaagtcggcacgagcttctcgtatgatgagcggaatctcgtcagttctcttcatatcggagccaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatcattcaatatcatgaaccagctgacgaaggtgaatgacgaagacctgtcctatgataaaaatggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttgggcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaa

SEQ ID NO: 78 - DNA, 7038 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaagatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatatcggaagagttcagaaaccaagcacgaaaggcgttaataacaacaacgccacaggctggtttgatctttcctggaaagccgtatcaggcgcagccgggtataaaatgcaagtctttaacggcaaaggctttgaaatgcttgacctcggaaataaaacatcctggtccacaaaagatcaaaacatctggccgacaaaggcggaaatcagcgccggaaaatatgcgcttcacctgaaagacaaaaaaggtgcggaattgccgatcaacccaggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgataacgcaaacggcaattacaaagggaagaagaactattccttcacgctgaccgcctatgacgcaaacggtgacagcctaccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagatgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgataaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgacattgcgtacgacggacttgatgccgtttctgaaacggatcaaagcggaaaatcctcatccgccgccgtgtatgacaagtacggaaatctcattcaatcaagcaaagagctggcagcttcggcaagtctgctgaaagacggcagctttgaaggaacaaagctgggctggaatctcaccgctacgagagacagcggaagcatcgcgtctgtcaaaggaagaagcggcgcgctgtccggacaaaaagcattggagatcttgtcacaatccgcttcagccggaacggagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacagggatgtccaaggctgacggcgtaaaatttacgaacgacaatgattacgcgcttcaggctgacgtcacttatgcggacggcacgacgggcgtctacaccgctaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccgacgcggaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaggtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagtggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcttccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaatgacaaccgctaccgctacgcaggctaccaatacgacgaagaaaccggcctgtactatctcatggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcagcttcgaactttgggcccgggaaagtgtttaaaggtgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtga

SEQ ID NO: 79 - DNA, 7038 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattatggctttaagcttcacacaaacggaaacggaaaagagtattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaactccggcggcagctatcaggcaagtaaaaattactgggtcgcggtcagcgcggtgtttgaccagggagaaggcgccatgtctgcggccgccaaacccgtcattccgaatattggaagagttcagaaaccgagcacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgattaacccgggccccgtttataaaaacgccgacggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgccaatctcatatgggataaagtcaaaaacgccaaaggctacaaaatcaacatctacaacggaaaagactatcaatcattcgatgtcggggataccgatcattggacgacccaaaacaaacacatctggccttcagtcgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcggaccggggctcggactctcccggaccttcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaacttacggaaacaagcgatcaatttgtattaaaaacaaaagatcagacgaacgcttatttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtttgaccaaagccgtcaatgcgaaaaaagaaacgtacgactacagctatgacgcggacaaaaaaacgctgctcatgacgcagccgaacggccgcaaagtgcagtacggctataatgaggcgggcaatccgattcagctgattgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgacattgcgtacgacggacttgatgccgtttctgaaacggatcaaagcggaaaatcctcatccgccgccgtgtatgacaagtacggaaatctcattcaatcaagcaaagagctggcagcttcggcaagtctgctgaaagacggcagctttgaaggaacaaagctgggctggaatctcaccgctacgagagacagcggaagcatcgcgtctgtcaaaggaagaagcggcgcgctgtccggacaaaaagcattggagatcttgtcacaatccgcttcagccggaacggagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacagggatgtccaaggctgacggcgtaaaatttacgaacgacaatgattacgcgcttcaggctgacgtcacttatgcggacggcacgacgggcgtctacaccgctaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccgacgcggaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaggtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagtggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcttccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaatgacaaccgctaccgctacgcaggctaccaatacgacgaagaaaccggcctgtactatctcatggcccgctactacgaaccaagaaacggcgtgttcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggcagcggcttcgaactttgggcccgggaaagtgtttaaaggtgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtga

SEQ ID NO: 80 - DNA, 7038 bp, Bacillus amyloliquefaciens
atgaaaataggaaaaaagaacaagtggaaaaaatggctggccggcactcttgcggcaacgctgatgatttccattgcgcctgccgatgtgtttgcggcagaaacgcgtgaaaaacaagatcaagcgaaaaccgccgccattccggccgcagacccggaaaaagatcttccggcggaaaaagcatctgagcagatgccttttgatcaaaaagatatcaatcaagacggtgagatcacgtcagaaagaactgagaattcaaagctttactatgaaggcgagggtgtgtacaaacaggaaatctacacagaccccatacatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacatgatgatcataagctcacatactcattaaccggcgcaaaaggccccgatcaggctgcaatcactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgataaagacaatgtcgtctacaccgtgccgaagccctttatgaccgactcagatctcgacgaaaagtcaggtgaagtcagcaggtcagaagatgtcagcttcaagcttgaaaaaaacagtgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggatgccggattgaaagcgtacgtgctgaaaactggatattatgatggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctctataacgggaaagaataccaggccattccggtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaacgccggcggcagctatccggcaagtaaaaattactgggtcgcggtcagcgcggtgtttgaccagggagagggcgccatgtctgcggccgccaagcccgtcattccgaatatcggaagagttcagaaaccaagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggctccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcggaccggggctcggactctcccggaccttcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaacttacggaaacaagcgatcaatttgtattaaaaacaaaagatcagacgaacgcttatttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctttaacagggccgaaaaacaaaaagatttcatattcatatgacaaagaccttcttaaaaaggtgacggatactgacggcagcgtcacaagctacgactatgatgccgaagggcgcctcgtcaagcagtattccgcaaacagcacggatgataaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaggcgggcaacccgatccagatgatcgatgatgccgaagggctgaaaatcacgaccaacactgtatacgaaggcaacaacgtcattcaggacaccgacccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacatcactgatattgcgtacgacggacttgatgccgtttctgaaacggatcaaagcggaaaatcctcatcagccgccgtgtatgacaagtacggaaatctcattcaatcaagcaaagagctggcagcttcggcaagtctgctgaaagacggcagctttgaaggaacaaagctgggctggaatctcaccgctacgagagacagcggaagcatcgcgtctgtcaaaggaagaagcggcgcgctgtccggacaaaaagcattggagatcacctcacaatcctctactgccggaacagagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacgctaggccaaagcgcggacgataagccggtatatatcacgctgacagggatgtccaaggctgacggcgtaaaattaacgaacgacaatgattacgctcttcaggctgacgtcacttatgcggacggcacgacgggcgtatacaccgccaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcggaccggcgcggatcagacctatcaatatgaatatgacgtcatgggcaagctcgtcaaaacaaccgacccgctcggcaatgtactgaagagtgaatatgacgccaacagtaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacgaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaatgttactaccacaaaggacggcgcaagcaaatcagtcaacgcatccttcaacatcatgaatcagctgacgaaggtgaatgacgaagacctgtcctatgataaaaacggcaaccgcacatccgacggcaaattcacatatacgtgggacgcggaagacaacctgacagccgtaacgaaaaaaggcgaagacaagccgttcgcaacatacaaatacgatgaaaaaggaaacagaatccaaaaaaccgtcaacggaaacgtcacaaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatcacagacagcaccggaaaaaccgttgccaaatatcagtacgatgcgtggggaaatccgacaaaaaccgaagcaagagacgaagtaaaagacaaccgctaccgctacgcaggctaccaatacgacgaagaaaccggcttgtactatctcatggcccgctactacgaaccaagaaacggtgtattcttatcactagacccagacccgggaagtgacggcgattctttagatcagaatggatatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagcggcttcgaactttgggcctgggaaagtgtttaaaggcgctaagaaggctttgggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcggatcaccaaccagtatcaaaattaaggaagaaaggccagcgacaaaggctatatcctcattgtcaaacttgttcacgaaaacaaggaggatatactagtgctattctgagaaaaagacatcaacggaggtga

SEQ ID NO: 81 - DNA, 7005 bp, Bacillus amyloliquefaciens
atgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggccgcagacccggaaaaagatcttccggcggaaaaagcacccgagcagatgccgtttaatcaaaaagatatcaatcaagacggtgagatcacgtctgaaagaactgagaattcaaagctttattatgaaggcgagggtgtgtacaaacaggaaatctacacagaccccattcatacgaaagaaaccgccaatgcggactgggaagacgtttcccctgaattgaaaaccggatcaaaggaagtcggaacggagaatacagtgctgaactccgattttctgaagcaaatgaaaaacggattatacgctacatttgaacacgatgatcataagctcacatactcattaaccggcgcaaaaggccccgatcaggctgcaatcactccgacagatgcctcagcaaaagtcaagggagacagcaacgagcttacgtatcagcaagtgtttcctgctattgatttacaaacctacacatttaacgaaaacataaaagaagaccttgtgcttcataaatatgaaggctacaattccttcacctttcaaatcaaaaccgaccttcaggctaaagaacaggaagacggctcgatcgcgttttctgatgatgaagacaatgtcgtctacaccgtgccgaagccctttatgaccgactcagatctcgacgaaaagtcaggtgaagtcaacaggtcagaagatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggatgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgataatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctctataacgggaaagaataccaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaacgccggcggcagctatccggcaagtaaaaattactgggtcgcggtcagcgcggtgtttgaccagggagaaggcgccatgtctgcggccgccaagcccgtcattccgaatatcggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgattaacccgggccccgtttataaaaacgccggcggagatgcgaaccggaaaacttacggatttaaagttatcgcctataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacgcatctggccgtcagccgaagaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacctttaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagacgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtacagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgccgtttctgaaacggatcaaagcggaaaatcctcatccgccgccgtgtacgacaaatacggtaatctcattcaatcaagcaaagagctggcagcttcggcaagcctgctgaaagacggcagctttgaaggaacaaagcttggctggaatctcactgctacgagagacagcggaagcatcgcatctgtaaaagcaagaagcggcgcgctgtccggacaaaaagcattggagatctcgtcacaatccgcttcagccggaacagagcacggccatgcgtccgcaacgcaggaagtgcagctagagccgaatacgacgtatacactcagcggccagatcaaaacggatctgacgaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacgctaggccaaagcgcggacgataagccggtatatatcacgctgacagggatgtccaaggctgacggcgtaaaattaacgaacgacaatgattacgctcttcaggctgacgtcacttatgcggacggcacgacgggcgtatacaccgccaaattcccgcaggggacacaggaatggaaccgggcggcggcagtcattccgaaaacaaagccgatcaatagaatcgaaatcagcattctgttccaaaaaagcgccacaggaacggcgtggtttgacgacatccgtttaatcgaaggaagcatcctgacgaaaaacacctatgacgaaaaaggaaactacgtcacaaaagaagaagacgaactaggttatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcggaccggcgcggaccagacctatcaatatgaatatgacgtcatgggcaagctcgtcaaaacaaccgacccgctcggcaatgtgctgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatctcgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaatgttaccaccacaaaggacggcgcaagcaaatcagtcaacgcttccttcaacatcatgaaccagctgacgaaggtgaatgacgaagacctgtcctacgataaaaacggcaaccgcacatctgacggcaaatacacatatacgtgggacgcggaagacaacctgaccgccgtcacgaaaaaaggcgaagacaagccgttcgcaacatacaaatatgatgaaaaaggaaacagaatccaaaaaaccgtcaacggaaacgtcacgaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactcgatccagacccgggaagcgacggagattcgctggatcagaatggatatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagcggcttcgaactttggtcctgggaagttatttaagggtgctaaaagggtttataaagcggttcattctgtctatgttttaaaaaaaggaaagaaagttgtttatgtcggaagatcaaagaatctaaaaaaacgagctgctgttcataaaaagaatcatccagatacgcgaatggttaagaaaagaggaggattaacttatgctcaagcaagaggcttagagcatcggtattatttaaagtatggaggcaagaaaaaacttcgaaataaaatcaggccaataagtcgtaaaaataaaaaatataaatattatatgagttcttcaagaaaattttataaatag

SEQ ID NO: 82 - DNA, 7005 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatatcggaagagttcagaaaccaagcacgaaaggcgttaataacaacaacgccacaggctggtttgatctttcctggaaagccgtatcaggcgcagccgggtataaaatgcaagtctttaacggcaaaggctttgaaatgcttgacctcggaaataaaacatcctggtccacaaaagatcaaaacatctggccgacaaaggcggaaatcagcgccggaaaatatgcgcttcacctgaaagacaaaaaaggtgcggaattgccgatcaacccaggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgataacgcaaacggcaattacaaagggaagaagaactattccttcacgctgaccgcctatgacgcaaacggtgacagcctaccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggaccttcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgaccaatttgtattaaaaacaaaagatcagacgaacgcttatttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgccgtttctgaaacggatcaaagcggaaaatcctcatccgccgccgtgtacgacaaatacggtaatctcattcaatcaagcaaagagctggcagcttcggcaagcctgctgaaagacggcagctttgaaggaacaaagcttggctggaatctcactgctacgagagacagcggaagcatcgcatctgtaaaagcaagaagcggcgcgctgtccggacaaaaagcattggagatctcgtcacaatccgcttcagccggaacagagcacggccatgcgtccgcaacgcaggaagtgcagctagagccgaatacgacgtatacactcagcggccagatcaaaacggatctgacgaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacgctaggccaaagcgcggacgataagccggtatatatcacgctgacagggatgtccaaggctgacggcgtaaaattaacgaacgacaatgattacgctcttcaggctgacgtcacttatgcggacggcacgacgggcgtatacaccgccaaattcccgcaggggacacaggaatggaaccgggcggcggcagtcattccgaaaacaaagccgatcaatagaatcgaaatcagcattctgttccaaaaaagcgcaacaggaacggcgtggtttgacgacatccgtttaatcgaaggaagcatcctgacgaaaaacacctatgacgaaaaaggaaactacgtcacaaaagaagaagacgaactaggttatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccagcgcagaccagacctatcaatatgaatatgacgtcatgggcaagctcgtcaaaacaaccgacccgctcggcaatgtactgaagagtgaatatgacgccaacagtaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaatggcaatgtccagacattcatcagcggaaatgaagtcggcacgagcttctcatatgatgagcggaatctcgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatccttcaacatcatgaatcagctgacgaaggtgaatgacgaagacctgtcctatgataaaaacggcaaccgcacatccgacggcaaattcacatatacgtgggacgcggaagacaacctgaccgccgtaacgaaaaaaggcgaagacaagccgttcgcaacatacaaatatgatgaaaaaggaaacagaatccaaaaaaccgtcaacggaaacgtcacaaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatcacagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactagacccagacccgggcagcgacggagattctttagatcagaatggatatgcatacggaaacaacaacccggtgatgaacgtcgatcctgacgggcattgggtgtggcttgtggtaaatgccggatttgcagcctatgatggatataaggcctataaatcaggtaaaggatggagaggtgcagcctgggcagcggcttcgaactttggtcctgggaagttatttaagggtgctaaaagggtttataaagcggttcattctgtctatgttttaaaaaaaggaaagaaagttgtttatgtcggaagatcaaagaatctaaaaaaacgagctgctgttcataaaaagaatcatccagatacgcgaatggttaagaaaagaggaggattaacttatgctcaagcaagaggcttagagcatcggtattatttaaagtatggaggcaagaaaaaacttcgaaataaaatcaggccaataagtcgtaaaaataaaaaatataaatattatatgagttcttcaagaaaattttataaatag

SEQ ID NO: 83 - DNA, 7005 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgatcttcaggctaaagaacaggaagacggctctatcgcgttttctgatgataaagacaatgtcgtctacaccgtgccgaagccctttatgaccgactcagatctcgacgaaaagtcaggtgaagtcagcaggtcagaagatgtcagcttcaagcttgaaaaaaacagtgaagggtacttgctccatgtaacggccgatgaaaaatggctgaaagatcccaagcgggtttatccggtatctattgacccttcaacatcagtatctgtgtcgtccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtaacgaaagcgacgctcaaagcgtacacagcccactcctattacggatcaaaggcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaacgccggcggcagctatccggcaagtaaaaattactgggtcgcggtcagcgcggtgtttgaccagggagaaggcgccatgtctgcggccgccaagcccgtcattccgaatatcggaagagttcagaaaccaagcacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaagaccaaaacatctggccgacaaaggcagaaatcagcgccggaaaatatgcgcttcacctgaaagacaaaaaaggtgcggaattgccgatcaacccgggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagattatcaatcattcgatgtcggggataccgatcattggacgacccaaaacaaacgcatctggccgtcagccgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagatggcagagccgtttatattgatgaggacgcgacagcacatgtcttcacgaaaaaatctgacggcacgtatcagccgccgacgggcgtttatctcgaactgacggaaacaagcgaccaatttgtattaaaaacaaaagatcagacgaacgcttatttcagcaaaaaaggcggcaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgataaaccgctgttcactgaataccaatacagcggccaccgcctgaccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggaaacgtcacagccgtaaaagacaactacggcaccgaaacgtatcagtacaacaaaaacaatgacgtaacgaaaatgaaggataccgaggggaacatcactgatattgcgtacgacggacttgatgccgtttctgagacggatcaaagcggaaaatcctcatccgccgccgtgtatgacaagtacggaaatctcattcaatcaagcaaagagctggcagcttcggcgagcctgctgaaagacggcagctttgaaggaacaaagcttggctggaatctcactgctacgagagacagcggaagcatcgcgtctgtcaaaggaagaagcggcgcgctgtccggacaaaaagcattggagatcacctcacaatcctctactgccggaacagagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacggggatgtccaaggctgacggcgtaaaatttacgaatgacaatgattacgctcttcaggctgacgtcacttatgcggacggcacgacgggcgtctacaccgccaaattcccgcaggggacacaggaatggaaccgggcagcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacatcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccgccaccaaggacggcgcaagcaaatcagtcaacgcatccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacagagaacggcaagaaatatttctatcactacaacgcacacggtgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactagacccagacccgggcagtgacggcgattctttagatcagaatggatatgcatacggaaacaacaacccggtgatgaacgtcgatcctgacgggcattgggtgtggcttgtggtaaatgccggatttgcagcctatgatggatataaagcatataaatcaggtaaaggatggagaggtgcagcctgggcagcggcttcgaactttggtcctgggaagttatttaagggtgctagtcgggcttataaagcggttcattctgtctatgttttaaaaaaaggaaagaaagttgtttatgtcggaagatcaaagaatctaaaaaaacgagccgctgttcacaaaaaaaaccatccagatacgcgaatggttaagaaaagaggaggattaacttatgctcaagcaaggggcttagagcatcggtattacttaaagtatggaggtaagaaaaaacttcgaaataaaatcagaccaataagtcgtaaaaataaaaaatataagtattatatgagttcttcaagaagattttataagtag

SEQ ID NO: 84 - DNA, 7041 bp, Bacillus amyloliquefaciens
atgaaaataggaaaaaagaacaagtggaaaaagtggctggccggcactcttgcggccacgctgatgatttccattgcgcctgccgatgtgtttgcggcagaaacgggtgaaaaacaagatcaagcgaaaaccgccgccattccggccgcagactcggaaaaagatcttccggcggaaaaagcatctgagcagatgccgtttgatcaaaaagatatcaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttcccctgaattgaaaaccggctcaaaggaagtcggaacggaaaatacagtgctgaattccgattttctgaagcaaatgaaaaacggattatacgccacatttgaacatgatgatcataagctcacatactcattaaccggcgcaaaaggccccgatcaggctgcaatcactccgacagatgcctcagcaaaagtcaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccttttatgaccgactcagatctcgatgaaaagtcaggtgaagtcagcaggtcagaagatgtcagcttcaagcttgaaaaaaacagcgaaggctacttgctccatgtaacggccgatgaaaaatggctgaaagatcccaagcgggtttatccggtatctattgacccgtcaacatcagtatctgtgtcatccgatacctttgtcatgagcgcgtacccgacgacaaactactctgccgcgtcgcagaaatgggatgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaagagggaaaaagatttggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggaagagttcagaaaccaagcatgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaaaatcaaaacatctggccgacaaaggcggaaatcagcgccggaaaatatgcgcttcacctgaaagacaaaaaaggtgcggaattgccgatcaacccgggccccgtttataaaaacgccagcggagatgcgaaccggaaaacctacggatttaaagtcattgcctataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggtgataccgatcattggacgactcaaaacaaacacatctggccttcggtcgatgaagtgaaagcgggaagattccagcttcacacggacggaaagggcggcgaactggcgcttgacccatcacctgtttacgaaaacgcaaacggcaattacaaaggaaagaagaactattccttcacgctgaccgcctatgacgcaaacggtgacagcataccgacggcaccttttaaccctgttttccatgaaggggcggaattcctcggaacggaagaattctggtccattattgacattccggacggacagctgaatggcgcaacgggaaatgtcatcgtcaatgaagaagatatgtcaatcgacggacgcggaccggggctcggactctcccggaccttcaacagccttgacagctctgaccatatgttcggccaaggctggtatgccgatgcggacacgtcgattctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagacgaacgcttatttcagcaaaaaaggcggaaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacggctatgatgccgaagggcgcctcgtcaagcagtattccgcaaacagcacggatgacaaaccgctgttcactgaataccaatacagcggccaccgtctgaccaaagccgtcaatgcgaaaaaagaaacgtacgactacagctacgacgcgggcaaaaaaacgctgctcatgacgcagccgaacggccgcaaagtgcagtacggctataatgaggcgggcaacccgattcagatgatcgatgatgccgaagggctgaaaatcaccaccaacactgtatacgaaggcaacaacgtcattcaggacaccgatccgaacgacgcggatgcgggcaaagcgacagaaagctatcaatatgataaagacggaaacgtcacagccgtaaaagacaactacggcaccgaaacgtatcagtacaacaaaaacaatgacgtgacgaaaatgaaggataccgaggggaacgtcaccgatattgcgtacgacggactggatgccgtttctgaaacggatcaaagcggaaaatcctcatccgccgccgtgtatgacaagtacggaaatctcattcaatcaagcaaagagctggcagcttcggcgagcctgctgaaagacggcagctttgaaggaacaaagcttggctggaatctcactgctacgagagacagcggaagcatcgcgtctgtcaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagatcacctttaccacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggctaaagcagacggctggagcacaagcggagccgccgctgaccttgatgaaggcttcgatgatgacagctcattaaaagcgtcccgcacaaatgcatcacaagccaatgcggccgcaaaacaaaccgttacattaggccaaagtgcggacgataagccggtatatatcacgctgacagggatgtccaaggcagacggcgtaaaattaacgaacgacaatgattacgcgcttcaggccggcgtcacctatgcggacggaacgacgggcgtatacaccgccaaattcccgcaggggacgcaggaatggaaccgggcggcggcagtcattccgaaaacaaagccgatcaataaaatcgaaatcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgactgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtccagtacgaatatggcaagctcaaccagctcgtcaaagaaactcatgaagacggcaccgtcattcaatatacgtacgacggcttcggcaaccggacaaacgtcaccgccacaaaggacggcgcaagcaaatcagtcaacgcttccttcaacattatgaaccagctgacgaaggtgaatgacgaagaactgtcctacgataaaaacggcaaccgcacatctgacggcaaatacacatacacgtgggacgcggaagacaacctgaccgccgtaacaaaaaaaggcgaagacaagccgttcgcaacatacaaatacgatgaaaaaggaaacagaatccaaaaaaccgtcaacggaaacattacgaactacttctacgacggagacagcttgaacgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgaaccaagaaacggtgtattcttatcactagacccagacccgggaagtgacggcgattctttagatcagaatggatatgcatacggaaacaacaacccagtgatgaatgttgatccagatgggcattgggtgtggcttgtggtaaatgccggatttgcagcctatgatggatataaggcctataaatcaggtaaagggtggagaggtgcagcctgggcagcggcttcgaactttggtcctgggaagttatttaagggtgctagtcgggtttataaagctacccaacaaatgagtaggagggcttcattcagggctgctaaacgggctgccggaatacctacttcttctcaatataaaacacataaaaaagtatacgatggtagtagcgagcatagaactgtatattcttttggtagagttggaagaggaagtcataaaaaatatgtggtacttcataaacatgataaacgaggtagagggccccattttcatggtgttggaaaaggtagaagtcccttgaaaaaagggaggtacaatcaacttaaaggacattatccagaacattttaaaggatatagaacaaaaagaaggagatag

SEQ ID NO: 85 - DNA, 7014 bp, Bacillus amyloliquefaciens
atgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgagaattcaaaactttattatgagggcgaaggtgtatacaaacaggaaatctacacagaccccattcacacgaaagaaaccgccaatgcggactgggaagacgtttcccctgaattgaaaaccggctcaaaggatgtcgggacggaaaatacagtgctgaactccgattttctgaagcaaatgaaaaacggattatacgctacatttgaacatgatgatcataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgacaaagacaatgtcgtctacaccgtgccgaagccttttatgaccgactcagatctcgacgagaagtcaggtgaggtcagtaggtcagaagatgtcagcttcaagcttgaaaaaaacagcgaaggctacttgctgcatgtaacggccgatgaaaaatggctgaaagatcccaagcgggtttatccggtatctattgatccttccacatcagtatccgtgtcatccgatacctttgtcatgagtgcgtacccgacgacaaactactctgccgcgtcgcagaaatgggacgccggattgaaagcgtacgtgctgaaaacaggttattatgacggcacaaccggaacgaactacgcatttatgaagtttgataatctaaagccgatcaaaaacatgacggtgacaaaagcgacgcttaaagcatacacagcccactcctattacggatcaaaggcgacggggctttggctcgacaccgtaaacagcaattacgacaatgccaagatcacgtggaaaaacaagccgggctccaaaaacatcggcaaagccgaggtctataaaggccaatgggcaagcttcgatgtcacatccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtgtggctttataacgggaaagaatatcaggccatttctgtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaacgccggcggcagctatccggcaagcaaaaattactgggtcgcggtcagcgcggtgtttgaccagggagagggcgccatgtctgcggccgccaagcccgtcattccgaatatcggaagagttcagaaaccaagcacgaaaggctttaataacaacaacgccacaggctggtttgatctttcctggaaatccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaacgccggcggagacgcgaaccggaaaacctacggatttaaagtcattgcttataacaaagacggagaagcgatcgcctcaccggaagcgagtccggcgctgcctgatatcgcaaagccgaaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccgtcagccgatgaagtgaaagcgggaaaattccagcttcacacggacggaaagggcggcgaactggcgcttgacccttcacctgtttacgaaaacgcaaacggcaattacaaagggaagaagaactattcctttacgctgaccgcctatgacgcaaatggtgacagtataccgacggcaccttttaaccctgttttccatgaaggtgcggaattcctcggaacggaagaattctggtctattatcgacattccggacggacagctgaacggcgcgacgggaaatgtcatcgtcaatgaagaagatatgtcaatcgacggacgcgggccggggctcggactctcccgggcctttaacagccttgacagctctgaccatatgttcggccaaggctggtatgccgatgcggaaatgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctgaccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtgacgaaaatgaaggataccgaggggaacgtcactgatattgcgtacgacggacttgatgctgtttctgagacggatcaaagcggaaaatcctcatccgccgccgtgtatgacaagtatggaaatctcattcaatcaagcaaagagctggcagcttcggcaagcctgctgaaagacggcagctttgaaggaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacatttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggccaaaacagacggatggagcacaagcggaaccgccgctgaccttgatgaaggcttcgatgatgacagctcattaaaagcgtcccgcacaaatgcatcacaagccaatgcggccgcaaaacaaaccattacattaggccaaagcgcggacgataagccggtatatatcacgctgacagggatgtccaaggctgacggcgtaaaattaacgaacgacaatgattacgcgcttcaggccggcgtcacttatgcggacggcacgacaggcgtctacaccgccaaattcccgcaggggacacaggaatggaaccgggcggcggcagtcattccgaaaacaaagccgatcaataaaatcgaaatcagcattctattccaaaaaagcgccacaggaacggcgtggtttgatgacatccgattaatcgaaggaagcatcctgacgaaaaacacctatgacgaaaaaggaaactacgtcacaaaagaagaagacgaactaggttatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcaaaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcgtatgatgagcggaatctcgtcagttctcttcatatcggagccaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcaccgtcattcaatatacatacgacggcttcggcaaccggacaaatgttaccaccacaaaggacggcgcaagcaaatcagtcaacgcatcattcaatatcatgaaccagctgacgaaggtgaatgacgaagacctgtcctatgataaaaacggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaacgtcctgtatgaaacagacgccgacaacaacgtcacaaaatcatacacgtatggtgacagcggccagctgttatcctatacagagaacggcaagaaatatttctatcactacaacgcacacggcgacgtcatcgccatctcagacagcacgggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaaaagggtttataagtttgcgagcagttccagaaaagtaaagcaaattgactggaaacatataaagaagggtcactcacctaaatctaaaatccctaataaaggaaaattcaagagcaatagagcaatgaaaagaacgaccagacacacattaaaaagaggaaaagctagaccaggtcattcaggtgctactgtatacgaaaaaaaatttaaaaggtatgttggaataaatagtagggggaagaagacaaaaagggttagagtggttgttcagccgaatgggaaactgagaacaagttttccgtactga

SEQ ID NO: 86 - DNA, 7041 bp, Bacillus amyloliquefaciens
atgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggccgcagacccggaaaaagatcttccggcggaaaaagcacccgagcagatgccgtttaatcaaaaagatatcaatcaagacggtgagatcacgtctgaaagaactgagaattcaaagctttattatgaaggcgagggtgtgtacaaacaggaaatctacacagaccccattcatacgaaagaaaccgccaatgcggactgggaagacgtttcccctgaattgaaaaccggatcaaaggaagtcggaacggagaatacagtgctgaactccgattttctgaagcaaatgaaaaacggattatacgctacatttgaacacgatgatcataagctcacatactcattaaccggcgcaaaaggccccgatcaggctgcaatcactccgacagatgcctcagcaaaagtcaagggagacagcaacgagcttacgtatcagcaagtgtttcctgctattgatttacaaacctacacatttaacgaaaacataaaagaagaccttgtgcttcataaatatgaaggctacaattccttcacctttcaaatcaaaaccgaccttcaggctaaagaacaggaagacggctcgatcgcgttttctgatgataaagacaatgtcgtctacaccgtgccgaagccctttatgaccgactcagatctcgacgaaaagtcaggtgaagtcaacaggtcagaagatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggatgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaacgccggcggcagctatcaggcaagtaaaaattactgggtcgcggtcagcgcggtgtttgaccagggagaaggcgccatgtctgcggccgccaaacccgtcattccgaatatcggaagagttcagaaaccaagcacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaacgccggcggagatgcaaatcggaaaacttacggatttaaagttatcgcctataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacgcatctggccgtcagctgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacgtcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacctttaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagacgaacgcttatttcagcaaaaaaggcggcaagctccaaaaaatcgtcgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtgacgaaaatgaaggataccgaggggaacgtcaccgatattgcgtacgacggacttgatgccgtttctgagacggatcaaagcggaaaatcctcttccgccgccgtgtatgacaagtacggaaatctcattcaatcaagcaaagagctggcagcttcggcgagtctgctgaaagacggcagctttgaaggaacaaagctgggctggaatctcaccgctacgagagacagcggaagtattgcatctgtaaaagcaagaagcggcgcgctatccggacaaaaagcactggagatctcctcacaatccgcttcagccggaacagagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaactgttacattaggccaaagcacggacgataagccggtatatatcacgctgacggggatgtccaaggctgacggcgtaaaattaacgaacgacaatgattacgctcttcaggctgacgtcacttatgcggacggcacgacgagcgtctacaccgccaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccagcgcagaccagacctatcaatatgaatatgacgtcatgggcaagctcgtcaaaacaaccgacccgctcggcaatgtactgaagagtgaatatgacgccaacagtaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaatggcaatgtccagacattcatcagcggaaatgaagtcggcacgagcttctcatatgatgagcggaatctcgtcagctctcttcatatcggagcgaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcactgtcattcaatatacgtacgacggcttcggcaaccggacaaacgtcaccgccacaaaggacggcgcaagcaaatcagtcaacgcttccttcaacatcatgaaccagctgacgaaggtgaatgacgaagaactgtcctacgataaaaacggcaaccgcacatctgacggcaaatacacatatacgtgggacgcggaagacaacctgaccgccgtaacgaaaaaaggcgaagacaagccgttcgcaacatacaaatatgatgaaaaaggaaacagaatccaaaaaaccgtcaacggaaacgtcacgaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactcgatccagacccgggaagcgacggagattcgctggatcagaatggatatgcatacggaaacaacaacccagtcatgaacgtcgatccggatgggcattgggtgtggcttgtagtaaatgccggatttgcagcctatgatggatataaggcctataaatcaggtaaaggatggagaggtgcagcctgggcagccgcttcgaactttggtcctgggaagttatttaagggtgctagtcgggtttataaagctacccaacaaatgagtaggagggcttcattcagggctgctaaacgggctgccggaatacctacttcttctcaatataaaacacataaaaaagtatacgatggtagtagcgagcatagaactgtatattcttttggtagagttggaagaggaagtcataaaaaatatgtggtacttcataaacatgataaacgaggtagagggccccattttcatggtgttggaaaaggtagaagtcccttgaaaaaagggaggtacaatcaacttaaaggacactatccagaacattttaaaggatatagaacaaaaagaaggagatag

SEQ ID NO: 87 - DNA, 7014 bp, Bacillus amyloliquefaciens
atgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgtgaattcaaagctttattatgagggcgaaggtgtatacaaacaggaaatctacacagaccccattcacacgaaagaaaccgccaatgcggactgggaagacgtttcccctgaattgaaaaccggctcaaaggatgtcgggacggaaaatacagtgctgaactccgattttctgaagcaaatgaaaaacggattatacgctacatttgaacatgatgattataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggcaagagaacaggaagacggctcgatcgcgttttctgatgacaaagacaatgtcgtctacaccgtgccgaagccctttatgaccgactcagatctcgacgagaagtcaggtgaagtcagcaggtcagaagatgtcagcttcaagcttgagaaaaacagcgaaggctacttgctgcatgtaacggccgatgaaaaatggctgaaagatcccaagcgggtttatccggtatctattgacccgtcgacatcagtatccgtgtcatccgatacctttgtcatgagcgcgtacccgacgacaaactactctgccgcatcgcagaaatgggatgccggattgaaagcgtacgtgctgaaaactggatattatgacggcacaaccggaacgaactacgcatttatgaagtttgataatctaaagccgatcaaaaacatgacggtgacaaaagcgacgcttaaagcatacacagtccactcctattacggatcaaaggcgacggggctttggctcgacaccgtaaacagcaattacgacaatgccaagatcacgtggaaaaacaagccgggctccaaaaacatcggcaaagccgaggtctataaaggccaatgggcaagcttcgatgtcacatccgcagtcaagtcgtggaacaacggcggcgccaattacggctttaagcttcacacaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtgtggctttataacgggaaagaatatcaagccatttctgtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggcagagttcagaaaccaagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgattaacccgggccccgtttataaaaacgccggcggagacgcaaaccggaaaacatacggatttaaagtaatcgcctataacaaagacggagaagcgatcgcctcaccggaagctagtccggcgctgcctgatatcgcaaagccgaaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccgtcagccgatgaagtgaaagcgggaaaattccagcttcacaaggacggaaagggcggcgaactggcgcttgacccttcacctgtttacgaaaacgcaaacggcaattacaaagggaagaagaactattcctttacgctgaccgcctatgacgcaaacggtgacagcataccgacggcaccttttaaccctgttttccatgaaggtgcggaattcctcggaacggaagaattctggtctattatcgacattccggacggacagctgaacggagcgacgggaaatgtcatcgtcaatgaagaagatatgtcaatcgacggacgcggaccggggctcggactctcccggaccttcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacgggtgacaaaccgctgttcactgaataccaatacagcggccaccgtctgaccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacatcactgatattgcgtacgacggactggatgccgtttctgaaacggatcaaagcggaaaatcctcatccgccgccgtgtatgacaaatacggtaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacatttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggccaaaacagacggatggagcacaagcggaaccgccgctgaccttgatgaaggcttcgatgatgacagctcattaaaagcgtcccgcacaaatgcatcacaagccaatgcggccgcaaaacaaaccattacattaggccaaagcgcggacgataagccggtatatatcacgctgacagggatgtccaaggctgacggcgtaaaattaacgaacgacaatgattacgcgcttcaggccggcgtcacctatgcggacggcacgacaggcgtctacaccgccaaattcccgcaggggacacaggaatggaaccgggcggcggcagtcattccgaaaacaaagccgatcaataaaatcgaaatcagcattctattccaaaaaagcgccacaggaacggcgtggtttgatgacatccgattaatcgaaggaagcatcctgacgaaaaacacctatgacgaaaaaggaaactacgtcacaaaagaagaagacgaactaggttatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcagtcacaaacaaagaacaaaatacaacgaaaaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaacgacggcacttcagcctatacatttgattatgatgaaaacggcaatgtccagacattcatcagcggcaatgaagtcggcacgagcttctcgtatgatgagcggaatctcgtcagctctcttcatatcggagccaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcaccgtcattcaatatacgtacgacggcttcggcaaccggacaaatgttaccaccacaaaggacggcgcaagcaaatcagtcaacgcatccttcaacatcatgaaccagctgacgaaggtgaatgacgaagacctgtcctatgataaaaacggcaaccgcacatctgacggcaaatacacatatacgtgggacgcggaagacaacctgaccgccgtcacaaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcgagcgacgaagtaaaagacaaccgctaccgctacgcaggctaccaatacgacgaagaaaccggcctgtactatctcatggcccgctactacgaaccaagaaacggtgtattcttatcactagacccagacccgggaagtgacggcgattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaaaagggtttataagtttgcgagcagttccagaaaagtaaagcaaattgactggaaacatataaagaagggtcacgcacctaaatctaaaatccctaataaaggaaaattcaagagcaatagagcaatgaaaagaacgaccagacacacattaaaaagaggaaaagctagaccaggtcattcaggtgctactgtatacgaaaaaaaatttaaaaggtatgttggaataaatagtagggggaagaagacaaaaagggttagagtggttgttcagccgaatgggaaactgagaacaagttttccgtactga

SEQ ID NO: 88 - DNA, 7017 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaacgccggaggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacgcatctggccgtcagctgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactggcggaaacaagcgaccaatttgtattaaaaacaaaagatcagacgaacgcttatttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgatattgcgtacgacgggcttgatgccgtttctgagacggatcaaagcggaaaatcctcatccgccgccgtgtatgacaaatacggaaatctcattcaatcaagcaaagagctggcagcttcggcgagcctgctgaaagacggcagctttgaaggaacaaagcttggctggaatctcaccgctacgagagacaacggaagtattgcatctgtaaaagcaagaagcggcgcgctgtccggacaaaaagcattggagatctcgtcacaatccgcttcagccggaacagagcacggccatgcgtccgcaacgcaggaagtgcagcttgagccgaatacgacgtatacactcagcggccagatcaaaacggatctgacgaaggcgagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacagggatgtccaaggctgacggcgtaaaatttacgaacgacaatgattacgctcttcaggctaacgtcacttatgcggacggcacaacgggcgtctacaccgccaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaagcaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacatcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccgccaccaaggacggcgcaagcaaatcagtcaacgcatccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacagagaacggcaagaaatatttctatcactacaacgcacacggtgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactagacccagacccgggcagtgacggcgattcgctggatcagaatgggtatgcatacggaaacaacaacccagtcatgaacgtcgatccggatgggcattgggtgtggcttgtggtaaatgccggatttgcagcctatgatggatataaagcatataaatcaggtaaaggatggagaggtgcagcctgggctgcggcttcgaactttggtcctgggaagttatttaagggtgctaaaagggtttataggtttgtaaaatctggtaaaaacttcaattggaaacatatcaaaaaagatcatggacctaagtcaaaagcccgaatgccaaatggccaaccgaaaagcaagtttagaagtgctaaaactcttagaagaacaacaaaggcaacagctagaactaaacctgcatacactcagaaagatggtaggacagtacattataaaaagtttaaaaagcctataggaagaaaaacgaatggtcggcatacttatactgtaaaggttgttaagtccggaaggtatgttgtaacaagctatccttattga

SEQ ID NO: 89 - DNA, 7032 bp, Bacillus amyloliquefaciens
atgaaaataggaaaaaagaacaagtggaaaaaatggctggccggcactcttgcggcaacgctgataatttccattgcgcctgccgatgtgtttgcggcagaaacgcgtgaaaaacaagatcaagcgaaaaccgccgccattccggctgcagacccggaaaaagatcttccggcggaaaaagcatctgagcagatgccttttgatcaaaaagatattaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacacaatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctctatcgcgttttctgatgataaagacaatgtcgtctacaccgtgccgaagccctttatgaccgactcagatctcgacgaaaagtcaggtgaagtcaacaggtcagaaaatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacacaaacggaaacggaaaagagtattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctttataacgggaaagaatatcaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgatcaacccgggccccgtttataaaaacgccggaggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacgcatctggccgtcagctgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacattcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactggcggaaacaagcgaccaatttgtattaaaaacaaaagatcagacgaacgcttatttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgatattgcgtacgacgggcttgatgccgtttctgagacggatcaaagcggaaaatcctcatccgccgccgtgtatgacaaatacggaaatctcattcaatcaagcaaagagctggcagcttcggcgagcctgctgaaagacggcagctttgaaggaacaaagcttggctggaatctcaccgctacgagagacaacggaagtattgcatctgtaaaagcaagaagcggcgcgctgtccggacaaaaagcattggagatctcgtcacaatccgcttcagccggaacagagcacggccatgcgtccgcaacgcaggaagtgcagcttgagccgaatacgacgtatacactcagcggccagatcaaaacggatctgacgaaggcgagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggtaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacagggatgtccaaggctgacggcgtaaaatttacgaacgacaatgattacgctcttcaggctaacgtcacttatgcggacggcacaacgggcgtctacaccgccaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaacacctatgacgaaaaagcaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtactgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacatcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccgccaccaaggacggcgcaagcaaatcagtcaacgcatccttcaacatcatgaaccagctgacgaaggtgaatgacgaagacctgtcctacgataaaaacggcaaccgcacatccgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcactaaatcatacacgtacggtgacagcggccagctgttatcctatacagagaacggcaagaaatatttctatcactacaacgcacacggtgacgtcatcgccatctcagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactagacccagacccgggcagtgacggcgattctttagatcagaatggatatgcatacggaaacaacaacccggtgatgaacgtcgatcctgacgggcattgggtgtggatggtagcaggagctttaattggcggaatttcatcttataaagcagcaaaagcaaagggggcaagaggttggaggttagttggatctgtagccttaggtgctgctggcggagcaatcgggggaaactatctacgagtaggacgtactctatataaggctggaaaattatctaaaacgtattggaacgctagaaaagttgcaaaagcaaacaaaggtgtaattaaaagagctagaaataagaaaggttgggtagttactactaaaaaacatacagtaagattaatgggaaggaattcaggacaaaggaaaagaccttattatcgaatgagtcatcataaaaaaggggccatgaacgcaaagggacactattcaaataaacaagctgagactcatattaaattaagatggcattcatatagaaatatcaataaaagattacgtaaggggagataa

SEQ ID NO: 90 - DNA, 6960 bp, Bacillus amyloliquefaciens
atgaaaataggaaaaaagaacaagtggaaaaaatggctggccggcactcttgcggcaacgctgatgatttccattgcgcctgccgatgtgtttgcggcagaaacgcgtgaaaaacaagatcaagcgaaaaccgccgccattccggccgcagacccggaaaaagatcttccggcggaaaaagcatctgagcagatgccttttgatcaaaaagatatcaatcaagacggtgagatcacgtcagaaagaactgagaattcaaagctttactatgaaggcgagggtgtgtacaaacaggaaatctacacagaccccatacatacgaaagaaaccgccaatgcggactgggaagacgtttctcctgaattgaaaaccggctcaaaggaagtcggaacggaaaatacagtgctgaattccgattttctgaagcaaatgaaaaacggattatacgctacatttgaacatgatgatcataagctcacatactcattaaccggcgcaaaaggccccgatcaggctgcaatcactccgacagatgcctcagcaaaagtcaaggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgataaagacaatgtcgtctacaccgtgccgaagccctttatgaccgactcagatctcgacgaaaagtcaggtgaagtcagcaggtcagaagatgtcagcttcaagcttgaaaaaaacagtgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacaattccgaaggcggacacgccgtctgtcaaagcgtatcataacggagattcgacaggatttttcaatatcagctggaaaaaagctgaaggcgccaaaagctataaagtctggctctataacgggaaagaataccaggccattccggtcggcaatgcaacctcttggagcacaaaaggaaaaaacatctggccgacaaaagcggaaatcgactccggcaaatataagctgcatacagacggaaaaggcggaactgaattagcgcttaatccttcgccggtctataaaaacgccggcggcagctatccggcaagtaaaaattactgggtcgcggtcagcgcggtgtttgaccagggagagggcgccatgtctgcggccgccaagcccgtcattccgaatatcggaagagttcagaaaccaagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccagaaaatatgcgcttcacctgaaagacaaaaaaggcgcggaattgccgatcaacccgggccccgtttataaaaacgccggcggagatgcgaaccggaaaacctacggatttaaagtcattgcttataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccttcagccgatgaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcggaccggggctcggactctcccggaccttcaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaacttacggaaacaagcgatcaatttgtattaaaaacaaaagatcagacgaacgcttacttcagcaaaaaaggcggcaagctccaaaaaatcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaggggcgcctcgtcaagcagtattccgcaaacagcacggatgacaaaccgctgttcactgaataccaatacagcggccaccgactggccaaagccgtcaatgcgaaaaaagaaacgtacgactacagctatgacgcggacaaaaaaacgctgctcatgacgcagccgaacggccgcaaagtgcagtatggctataacgaagcgggcaacccgattcagatgatcgatgatgccgaagggctgaaaatcacgaccaataccgtatacgaaggcaacaacgtcattcaggacaccgatccgaacgacgcggatgcgggcaaagcgacagaaagctatcaatatgataaagacgggaacgtcacagccataaaagacaactacggcactgaaacgtatcagtacaacaaaaacaatgacgtgacgaaaatgaaggataccgaggggaacgtcactgatattgcgtacgacggacttgatgccgtttctgagacggatcaaagcggaaaatcctcatccgccgccgtgtatgacaagtacggaaatctcattcaatcaagcaaagagctggcagcttcggcgagcctgctgaaagacggcagctttgaaggaacaaagcttggctggaatctcactgttacgagagacagcggaagcatcgcgtctgtaaaagcaagaagcggcgcgctgtccggacaaaaagcattggagatctcgtcacaatccgcttcagccggaacagagcacggccatgcgtccgcaacgcaggaagtgcagctggagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggatggcaaaggaaaagcgtggtttgatcaggttcagctggaaaaaggcgaagtctcttcaagctataacccggtgcaaaacagcagtttcacggccaaaacagatggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacggggatgtccaaggctgacggcgtaaaatttacgaacgacaatgattacgcgcttcaggctgacgtcacttatgcggacggcacaacgggcgtctacaccgccaaattcccgcaggggacacaggaatggaaccgggcggcggcagtcattccgaaaacaaagccgatcaataaaatcgaactcagcattctgttccaaaaaagcgccacaggaacggcgtggtttgatgatatccgtttaatcgaaggaagcatcctgacgaaaaatacctatgacgaaaaaggaaactacgtcacaaaagaagaagacgaactagggtatgcaagcactgcttcatatgacgagactggaaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcggaccagacctatcaatatgaatatgacgtcatgggcaagctcgtcaaaacaaccgacccgctcggcaatgtaatgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaataaacagctttacgtacaacaaacttgatcaaatgattgaaatgaaagacggcacttcagcctatacatttgattatgatgaaaacggcagtgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcactgtcattcaatatacgtacgacggcttcggcaaccggacaaatgttaccaccacaaaggacggcgcaagcaaatcagtcaacgcatccttcaacatcatgaatcagctgacgaaggtgaatgacgaagacctgtcctacgataaaaacggcaaccgcacatccgacggcaaattcacatatacgtgggacgcggaagacaacctgaccgccgtaacaaaaaaaggcgaagacaagccgttcgcaacatacaaatacgatgaaaaaggaaacagaatccaaaaaaccgtcaacggaaacgtcacgaactacttctacgacggagacagcttgaatgtcctgtatgaaacagacgccgacaacaacgtcacaaaatcatacacgtacggtgacagcggccagctgttatcctatacaaagaacggcaagaaatatttctatcactacaacgcacacggcgacgtcatcgccatctcagacagcaccggaaaaaccgttgccaaatatcagtacgatgcgtggggaaatccgacaaaaaccgaagcgagcgacgaagtaaatgacaaccgctaccgctacgcaggctaccaatacgacgaagaaaccggcctgtactatctcatggcccgctactatgagccaagaaacggcgtattcttatcactcgatccagacccgggaagtgacggcgattcattggatcagaatggatatacttatgccaataacaatccggtgatgaaggtcgacccagatgggcactgggccagaattctatgggaagtaataaaaaggtcatggaatggtgctccaggaaagtgggcaaagaggaatgttggtaaggcatataatgcatcaaagaaatggactaaatcagttattaaaaaaggcgcaaaaaaaatcgcgaaaaggattccatatagaattcataaagtaggccgtataaaaggggatagagaaaaaggaagaggttattggggaataatctattcgagaaagaaaaagactgggaggtctatatatagatctctagagtggcatacaccacataataatcatggttatcatttacaaagtaataagttttctatatataaagggaaatggaaaaggggcagtgcacaatggcggtttacagtgtataaaagatag

SEQ ID NO: 91 - DNA, 6960 bp, Bacillus amyloliquefaciens
atgaaaataggaaaaaagaacaagtggaaaaagtggttggccggcactcttgcggccacgctgatgatttccattgcgcctgccgatgtgtttgcggcagaaacgcgtgaaaaacaagatcaagcgaaaaccgccgccattccggccgcagacccggaaaaagatcttccggcggaaaaagcatctgagcagatgccttttgatcaaaaagatatcaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttcccctgaattgaaaaccggctcaaaggaagtcggaacggaaaatacagtgctgaattccgattttctgaagcaaatgaaaaacggattatacgccacatttgaacatgatgatcataagctcacatactcattaaccggcgcaaaaggccccgatcaggctgcaatcactccgacagatgcctcagcaaaagtcaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaactgaccttcaggctaaagaacaggaagacggctcgatcgcgttttctgatgataaagacaatgtcgtctataccgtgccgaagccttttatgaccgactcagatctcgatgaaaagtcaggtgaagtcagcaggtcagaagatgtcagcttcaagcttgaaaaaaacagcgaaggctacttgctccatgtaacggccgatgaaaaatggctgaaagatcccaagcgggtttatccggtatctattgacccgtcaacatcagtatctgtgtcatccgatacctttgtcatgagcgcgtatccgacgacaaactactctgccgcttcgcagaaatgggacgccggattgaaagcgtacgtgctgaaaactggatattatgacggcacaaccggaacgaactacgcttttatgaagtttgataatctaaagccgatcaaaaacatgacggtgacgaaagcgacgcttaaagcatacacagcccactcctattacggatcaaaggcgacggggctttggctcgacaccgttaacagcaattacgacaatgccaagattacgtggaagaacaaaccgggctccaaaaacatcggcaaagcagaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtgtggctttataacgggaaagaatatcaagccattccggtcggcaatgcaacctcttggagcacaagagggaaaaagatttggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggcagagttcagaaaccaagtacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaagatcaaaatatctggccgacaaaggcggaaatcagcgccggaaaatatgcgcttcacctgaaagacaaaaaaggcgcggaattgccgatcaacccgggctctgtttataaaaacgccggcggagatgcgaaccggaaaacctacggatttaaagtcattgcctataacaaagacggagaagcgatcgcctcaccggaagcgagtccggcgctgcctgatatcgcaaagccgaaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcggtgataccgatcattggacgacccaaaacaaacacatctggccttcagccgatgaagtgaaagcgggaagattccagcttcacacggacggaaagggcggcgaactggcgcttgacccttcacctgtttacgaaaacgcaaacggcaattacaaagggaagaagaactattcctttacgctgaccgcctatgacgcaaacggtgacagcataccgacggcaccttttaaccctgttttccatgaaggggcggaattcctcggaacggaagaattctggtccattattgacattccggacggacagctgaacggcgcaacgggaaatgtcatcgtcaatgaagaagatatgtcaatcgacggacgcggaccggggctcggactctcccggaccttcaacagccttgacagctctgaccatatgttcggccaaggctggtatgccgatgcggaaacgtcgattctttctgaagacggcagagccgtttatattgatgaggacgcgacaacacatatcttcacgaaaaaatctgacggcacgtatcagccgccgacgggtgtttatctcgaactgacggaaacaagcgatcaatttgtattaaaaacaaaagatcagacgaacgcttatttcagcaaaaaaggcggaaagctccaaaaaatcgttgacggacacaacaacacaaccgtatacgagtataacgacagcaatcagctgaccgccataacagacgcatcagggcgcaagctgacatttacctatgatgaaaacggccatgtcacatctcttacagggccgaaaaacaaaaagatttcgtattcatatgacaaagaccttcttaaaaaggtgacggatactgacggcagcgtcacaagctatgactacgatgacgaggggcgcctcgtcaagcagtattctgcaaacagcacggatgacaaaccgctgttcactgaataccaatatagcggccaccgcctgaccaaagccgtcaatgcgaaaaaagaaacgtacgactacagctatgacgcggacaaaaaaacgctgctcatgacgcagccgaacggccgcaaagtgcagtacggctataatgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgatattgcgtacgacggacttgatgccgtttctgagacggatcaaagcggaaaatcctcatccgccgccgtgtatgacaagtatggaaatctcattcaatcaagcaaagagctggcagcttcggcaagcctgctgaaagacggcagctttgaaggaacaaagctgggctggaatctcaccgctacgagagacagcggaagtattgcatctgtaaaagcaagaagcggcgcgctgtccggacaaaaagcactggagatctcctcacaatctgcttcagccggaacagagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggaccataacgacaaggacggcaaaggaaaagcgtggtttgatcaggttcagctggaaaaaggcgaagtctcttcaagctataacccggtgcaaaacagcagtttcacggctaaagcagacggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacaggaatgtccaaggctgacggtgtaaaattaacgaacgacaatgattacgctcttcaggccggcgtcacttatgcggacggaacgacgggcgtctacaccgccaaattcccgcaggggacccaagaatggaaccggacagcggcagtcattccgaaaacaaagccgatcaataaaatcgaaatcagcattctgttccaaaaaagcgccacaggaacggcgtggtttgatgatatccgtttaatcgaaggaagcatcctgacgaaaaacacctatgacgaaaaaggaaactacgtcacaaaagaagaagacgaactaggttatgcaagcactgcttcatatgacgagactggcaagaaaacatctgaaaccgacgcgaaaggcgaaacaaccgcctacgaatacgatcagggcgaccagctgacaaagctgaccctgtcaaacggcacatccatccttcacagctatgacaaggaaggaaatgagctgacaaaaacgattcgggccgacgcagatcagacctatcaatatgaatatgacgtcatgggcaagctcgtcaaaacaaccgacccgctcggcaatgtactgaagagtgaatatgacgccaacagtaacctgacgaaaaccgtttccgccaacggaaatgaagtgtcgctgacctatgacggcaccgaccgggttaagacaaaagcgtataacggcactgaaaaatacaactttacctatgacaaaaacggtaatgaaacgtcggtcacaaacaaagaacaaaatacaacgaaaaaacgcacctatgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggcaatgaagtcggcacgagtttttcatatgatgagcggaatctcgtcagctctcttcatatcggagcgaaaaacggcggcagcatcttccgggaaagctatgaatatgacgctaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatccttcaacatcatgaaccagctgacgaaggtgaatgacgaagacctgtcctatgataaaaacggcaaccgcacatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgtcacaaactacttctacgacggagacagcttgaacgtcctgtatgaaacagacgccgacaataacgtcacaaaatcatacacgtacggtgacagcggccagctgttatcctatacagagaacggcaagaaatatttctatcactacaacgcacacggtgacgtcaccgcgatctcagacagcaccggaaaaaccgttgccaaatatcagtacgatgcatggggaaatccgacaaaaaccgaagcaagcgacgaagtaaaagacaaccgctaccgctacgcaggctaccaatacgacgaagaaaccggcctgtactatctcatggcccgctactacgagccaagaaacggcgtattcttatcactagacccagacccgggcagtgatggggattctttagatcagaatgggtatacttatgccaataacaatccggtgatgaaggtcgacccagatgggcattgggccagaattctatgggaagtaataaaaaggtcatggaatggtgctccaggaaagtgggcaaagaggaatgttggtaaggcatataatgcatcaaagaaatggactaaatcagttattaaaaaaggcgcaaaaaaaatcgcgaaaaggattccatatagaattcataaagtaggccgtataaaaggggatagagaaaaaggaagaggttattggggaataatctattcgagaaagaaaaagactgggaggtctatatatagatctctagagtggcatacaccacataataatcatggttatcatttacaaagtaataagttttctatatataaagggaaatggaaaaggggcagtgcacaatggcggtttacagtgtataaaagatag

SEQ ID NO: 92 - DNA, 7065 bp, Bacillus amyloliquefaciens
atgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggccgcagacccggaaaaagatcttccggcggaaaaagcacccgagcagatgccgtttaatcaaaaagatatcaatcaagacggtgagatcacgtctgaaagaactgagaattcaaagctttattatgaaggcgagggtgtgtacaaacaggaaatctacacagaccccattcatacgaaagaaaccgccaatgcggactgggaagacgtttcccctgaattgaaaaccggatcaaaggaagtcggaacggagaatacagtgctgaactccgattttctgaagcaaataaaaaacggattatacgctacatttgaacacgatgatcataagctcacatactcattaaccggcgcaaaaggccccgatcaggctgcaatcactccgacagatgcctcagcaaaagtcaagggagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgataaagacaatgtcgtctacaccgtgccgaagccctttatgaccgactcagatctcgacgaaaagtcaggtgaagtcaacaggtcagaagatgtcagcttcaagcttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggatgccggattgaaagcgtacgtgctgaaaactggatattatgacggcacaaccggaacgaactacgcttttatgaagtttgataatctaaagccgatcaaaaacatgacggtgacgaaagcgacgctcaaagcgtacacagcccactcctattacggatcaaaagcgacggggctttggctcgacaccgttaacagcaattacgataatgccaagattacgtggaagaacaagccgggctccaaaaacatcggcaaagccgaggtctataaaggccaatgggcaagcttcgatgtcacctccgcagtcaagtcgtggaacagcggcggcgccaattacggctttaagcttcacgcaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtctggctctataacgggaaagaataccaggccattccggtcggcaatgcaacctcttggagcacaaaaggaaaaaacatctggccgacaaaagcggaaatcgactccggcaaatataagctgcatacagacggaaaaggcggaagtgaattagcgcttaatccttcgccggtctataaaaacgccggcggcagctatccggcaagtaaaaattactgggtcgcggtcagcgcggtgtttgaccagggagaaggcgccatgtctgcggccgccaagcccgtcattccgaatattggaagagttcagaaaccgagcacgaaaggctttaataacaacaacgccacaggctggtttgatctttcctggaaagccgtatcaggcgcagccgggtataaaatgcaagtctttaacggcaaaggctttgaaacgcttgacctcggaaataaaacatcctggtccacaaaagatcaaaacatctggccgacaaaggcggaaatcagcgccggaaaatatgcgcttcacctgaaagacaaaaaaggcgcggaattgccgattaacccgggccccgtttataaaaacgccggcggagatgcaaatcggaaaacttacggatttaaagttatcgcctataacaaagacggagaagcgatcgcctcaccggaagcgagtccggcgctgcctgatatcgcaaagccgaaaaacctgacaggctatgtctatacgaacacgaaatcgagccaaacgggttatgtcaatctcatatgggataaggtcaaaaacgccaaaggctacaaaatcaacatttacaacggaaaagactatcaatcattcgatgtcggggataccgatcattggacgacccaaaacaaacgcatctggccgtcagccgaagaagtgaaagcgggaagattccagcttcacacggacggaaagggcggcgaactggcgcttgacccttcacctgtttacgaaaacgcaaacggcaattacaaagggaagaagaactattccttcacgctgaccgcctatgacgcaaacggtgacagcataccgacggcaccttttaaccctgttttccatgaaggggcggaattcctcggaacggaagaattctggtctattatcgacattccggacggacagctgaacggcgcgacgggaaatgtcatcgtcaatgaggaagatatgtcaatcgacggacgcgggccggggctcgggctctcccggacctttaacagccttgacagctctgaccatatgttcggccaaggctggtatgccgatgcggaaacgtcgatcctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagacgaacgcttatttcagcaaaaaaggcggaaagctccaaaaaatcgttgacggacacaacaatacaaccgtatacgaatataacgacagcaatcagctgaccgccataacagacgcatcagggcgcaagctgacatttacctatgatgaaaacggccatgtcacatctcttacagggccgaaaaacaaaaagatttcatattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcggccaccgtctggccaaagccgtcaatgcgaaaaaagaaacgtacgactacagctatgacgcggacaaaaaaacgctgctcatgacgcagccgaacggccgcaaagtgcagtacggctataacgaagcgggcaacccgattcagatgatcgatgatgccgaagggctgaaaatcacgaccaacaccgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgccgtttctgaaacggatcaaagcggaaaatcctcatccgccgccgtgtacgacaaatacggtaatctcattcaatcaagcaaagagctggcagcttcggcaagcctgctgaaagacggcagctttgaaggaacaaagcttggctggaatctcactgctacgagagacagcggaagcatcgcatctgtaaaagcaagaagcggcgcgctgtccggacaaaaagcattggagatctcgtcacaatccgcttcagccggaacagagcacggccatgcgtccgcaacgcaggaagtgcagctagagccgaatacgacgtatacactcagcggccagatcaaaacggatctgacgaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggatcataacgacaaggacggcaaaggaaaagcgtggtttgatcaggttcagctggaaaaaggcgaagtctcttcaagctataacccggtgcaaaacagcagtttcacggccaaaacagatggctggagcacaagcggatccgccgctgaccttgatgaaggcttcgatgatgacagctcattaaaagcgtcccgcacaaatgcatcacaagccaatgcggccgcaaaacaaaccgttacgctaggccaaagcgcggacgataagccggtatatatcacgctgacagggatgtccaaggctgacggcgtaaaattaacgaacgacaatgattacgctcttcaggctgacgtcacttatgcggacggcacgacgggcgtatacaccgccaaattcccgcaggggacacaggaatggaaccgggcggcggcagtcattccgaaaacaaagccgatcaatagaatcgaaatcagcattctgttccaaaaaagcgcaacaggaacggcgtggtttgacgacatccgtttaatcgaaggaagcatcctgacgaaaaacacctatgacgaaaaaggaaactacgtcacaaaagaagaagacgaactaggttatgcaagcactgcttcatatgacgagactggaaagaaaatgtctgaaaccgacgcgaaaggcgaaacaaccgcctacgaatacgatcaggccgaccagctgacaaagctgaccttgtcaaacggcacatccatccttcacagctatgacaaggaaggaaatgagctgacaaaaacgattcgggccggcgcagaccagacctatcaatatgaatatgacgtcatgggcaagctcgtcaaaacaaccgacccgctcggcaatgtgctgaagagtgaatatgacgccaacagcaacttgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgagaacggcaatgtccagacattcatcagcggaaatgaagtcggcacgagcttctcatatgatgagcggaatctcgtcagctctcttcatatcggagcgaaaaacggcggcagcatcttccgggaaagctatgaatacgacgccaacggcaaccgcacggtcatcgacagctcagcgggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatccttcaacatcatgaatcagctgacgaaggtgaatgacgaagacctgtcctatgataaaaacggcaaccgcacatccgacggcaaattcacatatacgtgggacgcggaagacaacctgaccgccgtaacgaaaaaaggcgaagacaagccgttcgcaacatacaaatatgatgaaaaaggaaacagaatccaaaaaaccgtcaacggaaacgtcacaaactacttctacgacggagacagcttgaatgtcctgtatgaaacagacgcagacaacaacgtcacaaaatcatacacgtacggtgacagcggccagctgttatcctatacaaagaacggcaagaaatatttctatcactacaacgcacacggcgacgtcatcgccatcacagacagcaccggaaaaaccgttgccaaatatcaatacgatgcatggggaaatccgacaaaaaccgaagcgagcgacgaagtaaaagacaaccgctaccgctacgcaggctaccaatacgacgaagaaaccggcctgtactatctcatggcccgctactacgagccaagaaacggcgtattcttatcactagacccagacccgggcagcgacggcgattctttagatcagaatggatatgcatacggaaacaacaacccagtcatgaacgtcgatcctgacgggcattgggtgtggcttgtggtaaatgccggatttgcagcctatgatggatataaggcatataaatcaggtaaaggatggagaggtgcagcctgggcagccgcttcgaactttggtcctgggaagttatttaagggtgctagtcgggtttataaagcggttaaaagttacaaatttgttcgaaaagcaaaaggtggtacgtataagggaaggcttaaaagtaaatattcaaagaagcgttttgtacccgatagttattggagtagaaaagcttcccattttggtacaccgaatagccgtattacccattatagattatataaaggcaggaaggagagatcgactgtaatatatgataaatatgggcgtcaaaagtatcgcatagatcactcgaatcatggtatgcctagagcgcattctaaaccacaccttcacgaatatcattttggaagaggttatgggccaaaaggaaaaaataaaactcataatttttggagatga

SEQ ID NO: 93 - protein, 2343 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVKGDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNAGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKAQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSADEVKAGRFQLHTDGKGGELALDPSPVYENANGNYKGKKNYSFTLTAYDANGDSIPTSPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPENKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSTDDKPVYITLTGMSKADGVKLTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNELDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKFTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAITDSTGKTVAKYQYDAWGNPTKTEASDEVNDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKIFKGASRIYKAAKTYKLSRKSVRARRAYSSYRDITGKTSRFKNYSTNVRRRTFEKNLRRQGWRKSVHHGGVITMTKNGNKYSLRKHAKSSPYPTAEYTPKGRKKFTHKIRMRH

SEQ ID NO: 94 - protein, 2343 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGTAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGVNNNNATGWFDLSWKAVSGAAGYKMQVFNGKGFEMLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYDNANGNYKGKKNYSFTLTAYDANGDSLPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQMNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKGRSGALSGQKALEILSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFNQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRADADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVNDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKIFKGASRIYKAAKTYKLSRKSVRARRAYSSYRDITGKTSRFKNYSTNVRRRTFEKNLRRQGWRKSVHHGGVITMTKNGNKYSLRKHAKSSPYPTAEYTPKGRKKFTHKIRMRH

SEQ ID NO: 95 - protein, 2343 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGTELALNPSPVYKNSGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYDNANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTEKSDGTYQPPTGVYLELTETSDQFVLKTKDQTNAYFSKKGGKLQKIVDGHNNTTVYEYNDSNQLTAITDASGRKLTFIYDENGHVTSLTGPKNKKISYSYDKDLLKKVTDTDGSVTSYDYDAEGRLVKQYSANSTDDKPLFTEYQYSGHRLTKAVNAKKETYDYSYDADKKTLLMTQPNGRKVQYGYNEAGNPIQLIDDAEGLKITTNTVYEGNNVIQDTDPNDADAGKATESYQYDKDGNVTAVKDNYGTETYQYNKNNDVTKMKDTEGNITDIAYDGLDAVSETDQSGKSSSAAVYDKYGNLIQSSKELAASASLLKDGSFEGTKLGWNLTATRDSGSIASVKGRSGALSGQKALEITSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKALFDQVQLEKGEVSSSYNPVQNSSFTAKTDGWSTSGAAADLDEGFDDDSSLKASRTNASQANAAAKQTVTLGQSADDKPVYITLTGMSKADGVKLTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGINSFTYNKLDQMIEMKDGTSAYTFDYDENGNVQTFISGNEVGTSFSYDERNLVSSLHIGAKNGGSIFQESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRIYKAAKTYKLSRKSVRARRAYSSYRDITGKTSRFKNYSTNVRRRTFEKNLRRQGWRKSVHHGGVITMTKNGNKYSLRKHAKSSPYPTAEYTPKGRKKFTHKIRMRH

SEQ ID NO: 96 - protein, 2343 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGVNNNNATGWFDLSWKAVSGAAGYKMQVFNGKGFEMLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYDNANGNYKGKKNYSFTLTAYDANGDSLPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQMNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKGRSGALSGQKALEILSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFNQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRADADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVNDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKIFKGASRIYKAAKTYKLSRKSVRARRAYSSYRDITGKTSRFKNYSTNVRRRTFEKNLRRQGWRKSVHHGGVITMTKNGNKYSLRKHAKSSPYPTAEYTPKGRKKFTHKIRMRH

SEQ ID NO: 97 - protein, 2343 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKDVGTENTVLNSDFLKQMKNGLYATFEHDDHKLTYSLTGAKGPDQAAITPTDASAKVKEDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTVHSYYGSKATGLWLDTVNSNYDNAKITWKNKPGSKNIGKAEVYKGQWASFDVTSAVKSWNSGGANYGFKLHANGNGKEYWKKLMSSANSNKKPYIEVTYTIPKADTPSVKAYHNGDSTGFFNISWKKAEGAKSYKVWLYNGKEYQAISVGNATSWSTKGKNIWPTKAEIDSGKYKLHTDGKGGSELALDPSPVYKNSGGSYPASKNYWVAVSAVFDQGEGAMSAAAKPVIPNIGRVQRPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGKFQLHKDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKVVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLTKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNITDIAYDGLDAVSETDQSGKSSSAAVYDKYGNLIQSSKELAASASLLKDGSFEGTKLGWNLTATRDSGSIASVKARSGALSGQKALEITSQSASAGTEHGHASATQEVQLEPNTTYTLSGQIKTDLTKARAYFNIDLRDKDQKRIQWIHNESGALAGKNDWTKRQITFTTPANAGKAIVYMEVDHKDKDGKGKAWFDQVQLEKGEVSSSYNPVQNSSFTAKADGWSTSGAAADLDEGFDDDSSLKASRTNASQANAAAKQTVTLGQSADDKPVYITLTGMSKADGVKLTNDNDYALQAGVTYADGTTGVYTAKFPQGTQEWNRAAAVIPKTKPINKIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNDTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLNAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYTYGNNNPVMNVDPDGHWVWLVVNAGFAAYDGYKAYKSGKGWRGAAWAAASNFGPGKLFKGANRIYKAAKTYKLSRKSVRARRAYSSYRDITGKTSRFKNYSTNVKRRTFEKNLRRQGWRKSVHHGGVITMTKNGNKYSLRKHAKSSPYPTAEYTPKGRKKFTHKIRMRH

SEQ ID NO: 98 - protein, 2343 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTNPIHTKETANADWEDVSPELKTGSKDVGTENTVLNSDFLKQMKNGLYATFEHDDHKLTYSLTGAKGPDQAAITPTDASAKVKEDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAISVGNATSWSTKGKNIWPTKAEIDSGKYKLHTDGKGGTELALNPSPVYKNAGGSYPASKNYWVAVSAVFDQGEGAMSAAAKPVIPNIGRVQKPSTKGFNNNNVTGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGKFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKVVDGHNNTTVYEYNDSNQLTAITDASGRKLTFTYDENGHVTSLTGPKNKKISYSYDKDLLKKVTDTDGSVTSYDYDAEGRLVKQYSANSTEDKPLFTEYQYSGHRLTKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNITDIAYDGLDAVSETDQSGKSSSAAVYDKYGNLIQSSKELAASASLLKDGSFEATKLGWNLTATRDSGSIASVKARSGALSGQKALEITSQSASAGTEHGHASATQEVQLEPNTTYTLSGQIKTDLTKARAYFNIDLRDKDQKRIQWIHNESGALAGKNDWTKRQITFTTPANAGKAIVYMEVDHKDKDGKGKAWFDQVQLEKGEVSSSYNPVQNSSFTAKTDGWSTSGTAADLDEGFDDDSSLKASRTNASQANAAAKQTITLGQSADDKPVYITLTGMSKADGVKLTNDNDYALQAGVTYADGTTGVYTAKFPQGTQEWNRAAAVIPKTKPINKIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRISDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLAINAGFAAYDGYKAYKSGKGWRGAAWAAASNFGPGKLFKGANRIYKAAKTYKLSRKSVRARRAYSSYRDITGKTSRFKNYSTNVKRRTFEKNLRRQGWRKSVHHGGVITMTKNGNKYSLRKHAKSSPYPTAEYTPKGRKKFTHKIRMRH

SEQ ID NO: 99 - protein, 2345 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGVNNNNATGWFDLSWKAVSGAAGYKMQVFNGKGFEMLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYDNANGNYKGKKNYSFTLTAYDANGDSLPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQMNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKGRSGALSGQKALEILSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRADADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVNDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKVFKGAKKALGFAKAAKKYLKPGKYARRSIPARSTSSRLNKKERRVLNKIGNKYGCHTCGRRHPGTKSRNWIADHQPVSKLRKKGQRQRLYPHCQTCSRKQGGYTSAILRKRHQRR

SEQ ID NO: 100 - protein, 2345 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGTELALNPSPVYKNSGGSYQASKNYWVAVSAVFDQGEGAMSAAAKPVIPNIGRVQKPSTKGFNNNNATGWFDLSWKAVSGAAGYKMQVFNGKSFETLDLGNKTSWSTKDQNIWPTKAEISAGKYALHLKDKKGAELPINPGPVYKNADGDANRKTYGFKVIAYNKDGEAIASPEASPALPDIAKPKNLTGYVYTNTKSSQTGYANLIWDKVKNAKGYKINIYNGKDYQSFDVGDTDHWTTQNKHIWPSVDEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLTKAVNAKKETYDYSYDADKKTLLMTQPNGRKVQYGYNEAGNPIQLIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKGRSGALSGQKALEILSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRADADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVNDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKVFKGAKKALGFAKAAKKYLKPGKYARRSIPARSTSSRLNKKERRVLNKIGNKYGCHTCGRRHPGTKSRNWIADHQPVSKLRKKGQRQRLYPHCQTCSRKQGGYTSAILRKRHQRR

SEQ ID NO: 101 - protein, 2345 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGTELALNPSPVYKNAGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGSVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNITDIAYDGLDAVSETDQSGKSSSAAVYDKYGNLIQSSKELAASASLLKDGSFEGTKLGWNLTATRDSGSIASVKGRSGALSGQKALEITSQSSTAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKLTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRTGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKFTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAITDSTGKTVAKYQYDAWGNPTKTEARDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKVFKGAKKALGFAKAAKKYLKPGKYARRSIPARSTSSRLNKKERRVLNKIGNKYGCHTCGRRHPGTKSRNWIADHQPVSKLRKKGQRQRLYPHCQTCSRKQGGYTSAILRKRHQRR

SEQ ID NO: 102 - protein, 2334 aa, Bacillus amyloliquefaciens
MKIGKKNKWKKWLAGTLAATLMISIAPADVFAAETREKQDQAKTAAIPAADPEKDLPAEKAPEQMPFNQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVKGDSNELTYQQVFPAIDLQTYTFNENIKEDLVLHKYEGYNSFTFQIKTDLQAKEQEDGSIAFSDDEDNVVYTVPKPFMTDSDLDEKSGEVNRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNAGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSAEEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKLTNDNDYALQADVTYADGTTGVYTAKFPQGTQEWNRAAAVIPKTKPINRIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRTGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGAKRVYKAVHSVYVLKKGKKVVYVGRSKNLKKRAAVHKKNHPDTRMVKKRGGLTYAQARGLEHRYYLKYGGKKKLRNKIRPISRKNKKYKYYMSSSRKFYK

SEQ ID NO: 103 - protein, 2334 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGVNNNNATGWFDLSWKAVSGAAGYKMQVFNGKGFEMLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYDNANGNYKGKKNYSFTLTAYDANGDSLPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKLTNDNDYALQADVTYADGTTGVYTAKFPQGTQEWNRAAAVIPKTKPINRIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRASADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKFTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAITDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGAKRVYKAVHSVYVLKKGKKVVYVGRSKNLKKRAAVHKKNHPDTRMVKKRGGLTYAQARGLEHRYYLKYGGKKKLRNKIRPISRKNKKYKYYMSSSRKFYK

SEQ ID NO: 104 - protein, 2334 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGTELALNPSPVYKNAGGSYPASKNYWVAVSAVFDQGEGAMSAAAKPVIPNIGRVQKPSTKGFNNNNATGWFDLSWKAVSGAAGYKMQVFNGKSFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSADEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATAHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLTKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNITDIAYDGLDAVSETDQSGKSSSAAVYDKYGNLIQSSKELAASASLLKDGSFEGTKLGWNLTATRDSGSIASVKGRSGALSGQKALEITSQSSTAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTATKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRAYKAVHSVYVLKKGKKVVYVGRSKNLKKRAAVHKKNHPDTRMVKKRGGLTYAQARGLEHRYYLKYGGKKKLRNKIRPISRKNKKYKYYMSSSRRFYK

SEQ ID NO: 105 - protein, 2346 aa, Bacillus amyloliquefaciens
MKIGKKNKWKKWLAGTLAATLMISIAPADVFAAETGEKQDQAKTAAIPAADSEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVKEDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTRGKKIWPTKAEIDSGKYKLHTDGKGGSELALNPSPVYKNSGGSYPASKNYWVAVSAVFDQGEGAMSAAAKPVIPNIGRVQKPSMKGFNNNNATGWFDLSWKAVSGAAGYKMQVFNGKSFETLDLGNKTSWSTKNQNIWPTKAEISAGKYALHLKDKKGAELPINPGPVYKNASGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSVDEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADADTSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYGYDAEGRLVKQYSANSTDDKPLFTEYQYSGHRLTKAVNAKKETYDYSYDAGKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEITSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKADGWSTSGAAADLDEGFDDDSSLKASRTNASQANAAAKQTVTLGQSADDKPVYITLTGMSKADGVKLTNDNDYALQAGVTYADGTTGVYTAKFPQGTQEWNRAAAVIPKTKPINKIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTATKDGASKSVNASFNIMNQLTKVNDEELSYDKNGNRTSDGKYTYTWDAEDNLTAVTKKGEDKPFATYKYDEKGNRIQKTVNGNITNYFYDGDSLNVLYETDADNNVTKSYTYGDSGQLLSYTKNGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRVYKATQQMSRRASFRAAKRAAGIPTSSQYKTHKKVYDGSSEHRTVYSFGRVGRGSHKKYVVLHKHDKRGRGPHFHGVGKGRSPLKKGRYNQLKGHYPEHFKGYRTKRRR

SEQ ID NO: 106 - protein, 2346 aa, Bacillus amyloliquefaciens
MKIGKKNKWKKWLAGTLAATLMISIAPADVFAAETREKQDQAKTAAIPAADPEKDLPAEKAPEQMPFNQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVKGDSNELTYQQVFPAIDLQTYTFNENIKEDLVLHKYEGYNSFTFQIKTDLQAKEQEDGSIAFSDDKDNVVYTVPKPFMTDSDLDEKSGEVNRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGTELALNPSPVYKNAGGSYQASKNYWVAVSAVFDQGEGAMSAAAKPVIPNIGRVQKPSTKGFNNNNATGWFDLSWKAVSGAAGYKMQVFNGKSFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSADEVKAGRFQLHTDGKGGELALDPSPVYENANGNYKGKKNYSFTLTAYDANGDSIPTSPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSTDDKPVYITLTGMSKADGVKLTNDNDYALQADVTYADGTTSVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRASADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTATKDGASKSVNASFNIMNQLTKVNDEELSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRVYKATQQMSRRASFRAAKRAAGIPTSSQYKTHKKVYDGSSEHRTVYSFGRVGRGSHKKYVVLHKHDKRGRGPHFHGVGKGRSPLKKGRYNQLKGHYPEHFKGYRTKRRR

SEQ ID NO: 107 - protein, 2337 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKDVGTENTVLNSDFLKQMKNGLYATFEHDDHKLTYSLTGAKGPDQAAITPTDASAKVKEDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAISVGNATSWSTKGKNIWPTKAEIDSGKYKLHTDGKGGTELALNPSPVYKNAGGSYPASKNYWVAVSAVFDQGEGAMSAAAKPVIPNIGRVQKPSTKGFNNNNATGWFDLSWKSVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGKFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRAFNSLDSSDHMFGQGWYADAEMSILSEDGRAVYIDEDATTHVFTKKSDGTYQPPTGVYLELTETSDQFVLKTKDQTNAYFSKKGGKLQKVVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLTKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEITSQSASAGTEHGHASATQEVQLEPNTTYTLSGQIKTDLTKARAYFNIDLRDKDQKRIQWIHNESGALAGKNDWTKRQITFTTPANAGKAIVYMEVDHKDKDGKGKAWFDQVQLEKGEVSSSYNPVQNSSFTAKTDGWSTSGTAADLDEGFDDDSSLKASRTNASQANAAAKQTITLGQSADDKPVYITLTGMSKADGVKLTNDNDYALQAGVTYADGTTGVYTAKFPQGTQEWNRAAAVIPKTKPINKIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGANQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRISDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLAINAGFAAYDGYKAYKSGKGWRGAAWAAASNFGPGKLFKGAKRVYKFASSSRKVKQIDWKHIKKGHSPKSKIPNKGKFKSNRAMKRTTRHTLKRGKARPGHSGATVYEKKFKRYVGINSRGKKTKRVRVVVQPNGKLRTSFPY

SEQ ID NO: 108 - protein, 2337 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTVNSKLYYEGEGVYKQEIYTDPIHTKETANADWEDVSPELKTGSKDVGTENTVLNSDFLKQMKNGLYATFEHDDYKLTYSLTGAKGPDQAAITPTDASAKVKEDSNELTYQQVFPAIDLQTYTFNENIKEDLVLHKYEGYNSFTFQIKTDLQAREQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTVHSYYGSKATGLWLDTVNSNYDNAKITWKNKPGSKNIGKAEVYKGQWASFDVTSAVKSWNNGGANYGFKLHTNGNGKEYWKKLMSSANSAKKPYIEVTYTIPKADTPSVKAYHNGDSTGFFNISWKKAEGAKSYKVWLYNGKEYQAISVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGKFQLHKDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKVVDGHNNTTVYEYNDSNQLTAITDASGRKLTFTYDENGHVTSLTGPKNKKISYSYDKDLLKKVTDTDGSVTSYDYDAEGRLVKQYSANSTGDKPLFTEYQYSGHRLTKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNITDIAYDGLDAVSETDQSGKSSSAAVYDKYGNLIQSSKELAASASLLKDGSFEATKLGWNLTATRDSGSIASVKARSGALSGQKALEITSQSASAGTEHGHASATQEVQLEPNTTYTLSGQIKTDLTKARAYFNIDLRDKDQKRIQWIHNESGALAGKNDWTKRQITFTTPANAGKAIVYMEVDHKDKDGKGKAWFDQVQLEKGEVSSSYNPVQNSSFTAKTDGWSTSGTAADLDEGFDDDSSLKASRTNASQANAAAKQTITLGQSADDKPVYITLTGMSKADGVKLTNDNDYALQAGVTYADGTTGVYTAKFPQGTQEWNRAAAVIPKTKPINKIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMNDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLAINAGFAAYDGYKAYKSGKGWRGAAWAAASNFGPGKLFKGAKRVYKFASSSRKVKQIDWKHIKKGHAPKSKIPNKGKFKSNRAMKRTTRHTLKRGKARPGHSGATVYEKKFKRYVGINSRGKKTKRVRVVVQPNGKLRTSFPY

SEQ ID NO: 109 - protein, 2338 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSADEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELAETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDNGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQANVTYADGTTGVYTAKFPQGTQEWNRAAAVIPKTKPINKIELSILFQKSATGTAWFDDIRLIEGSILTKNTYDEKANYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTATKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGAKRVYRFVKSGKNFNWKHIKKDHGPKSKARMPNGQPKSKFRSAKTLRRTTKATARTKPAYTQKDGRTVHYKKFKKPIGRKTNGRHTYTVKVVKSGRYVVTSYPY

SEQ ID NO: 110 - protein, 2343 aa, Bacillus amyloliquefaciens
MKIGKKNKWKKWLAGTLAATLIISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHNDHKLTYSLTGAKGPDQAAITPTDASAKVREDSNELTYQQVFPAIDLQTYTFNENIKEDLVLHKYEGYNSFTFQIKTDLQAKEQEDGSIAFSDDKDNVVYTVPKPFMTDSDLDEKSGEVNRSENVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHTNGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNSGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSADEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELAETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDNGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQANVTYADGTTGVYTAKFPQGTQEWNRAAAVIPKTKPINKIELSILFQKSATGTAWFDDIRLIEGSILTKNTYDEKANYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTATKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVIAISDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWMVAGALIGGISSYKAAKAKGARGWRLVGSVALGAAGGAIGGNYLRVGRTLYKAGKLSKTYWNARKVAKANKGVIKRARNKKGWVVTTKKHTVRLMGRNSGQRKRPYYRMSHHKKGAMNAKGHYSNKQAETHIKLRWHSYRNINKRLRKGR

SEQ ID NO: 111 - protein, 2319 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVKEDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGTELALNPSPVYKNAGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISARKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAIKDNYGTETYQYNKNNDVTKMKDTEGNVTDIAYDGLDAVSETDQSGKSSSAAVYDKYGNLIQSSKELAASASLLKDGSFEGTKLGWNLTVTRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGAAADLDEGFDDDSSLKASRTNASQANAAAKQTVTLGQSADDKPVYITLTGMSKADGVKFTNDNDYALQADVTYADGTTGVYTAKFPQGTQEWNRAAAVIPKTKPINKIELSILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVMKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGINSFTYNKLDQMIEMKDGTSAYTFDYDENGSVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKFTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAISDSTGKTVAKYQYDAWGNPTKTEASDEVNDNRYRYAGYQYDEETGLYYLMARYYEPRNGVFLSLDPDPGSDGDSLDQNGYTYANNNPVMKVDPDGHWARILWEVIKRSWNGAPGKWAKRNVGKAYNASKKWTKSVIKKGAKKIAKRIPYRIHKVGRIKGDREKGRGYWGIIYSRKKKTGRSIYRSLEWHTPHNNHGYHLQSNKFSIYKGKWKRGSAQWRFTVYKR

SEQ ID NO: 112 - protein, 2319 aa, Bacillus amyloliquefaciens
MKIGKKNKWKKWLAGTLAATLMISIAPADVFAAETREKQDQAKTAAIPAADPEKDLPAEKASEQMPFDQKDINQDGEITSERTENSKLYYEGEGVYKQEIYTDPIHTKETANADWEDVSPELKTGSKEVGTENTVLNSDFLKQMKNGLYATFEHDDHKLTYSLTGAKGPDQAAITPTDASAKVKEDSNELTYQQVFPAIDLQTYTFNENIKEDLVLHKYEGYNSFTFQIKTDLQAKEQEDGSIAFSDDKDNVVYTVPKPFMTDSDLDEKSGEVSRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTRGKKIWPTKAEIDSGKYKLHTDGKGGSELALNPSPVYKNSGGSYPASKNYWVAVSAVFDQGEGAMSAAAKPVIPNIGRVQKPSTKGFNNNNATGWFDLSWKAVSGAAGYKMQVFNGKSFETLDLGNKTSWSTKDQNIWPTKAEISAGKYALHLKDKKGAELPINPGSVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKHIWPSADEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHIFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDDEGRLVKQYSANSTDDKPLFTEYQYSGHRLTKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKADGWSTSGAAADLDEGFDDDSSLKASRTNASQANAAAKQTVTLGQSADDKPVYITLTGMSKADGVKLTNDNDYALQAGVTYADGTTGVYTAKFPQGTQEWNRTAAVIPKTKPINKIEISILFQKSATGTAWFDDIRLIEGSILTKNTYDEKGNYVTKEEDELGYASTASYDETGKKTSETDAKGETTAYEYDQGDQLTKLTLSNGTSILHSYDKEGNELTKTIRADADQTYQYEYDVMGKLVKTTDPLGNVLKSEYDANSNLTKTVSANGNEVSLTYDGTDRVKTKAYNGTEKYNFTYDKNGNETSVTNKEQNTTKKRTYDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKYTYTWDAEDNLTAVTKKGEDKPFATYKYDEKGNRIQKTVNGNVTNYFYDGDSLNVLYETDADNNVTKSYTYGDSGQLLSYTENGKKYFYHYNAHGDVTAISDSTGKTVAKYQYDAWGNPTKTEASDEVKDNRYRYAGYQYDEETGLYYLMARYYEPRNGVFLSLDPDPGSDGDSLDQNGYTYANNNPVMKVDPDGHWARILWEVIKRSWNGAPGKWAKRNVGKAYNASKKWTKSVIKKGAKKIAKRIPYRIHKVGRIKGDREKGRGYWGIIYSRKKKTGRSIYRSLEWHTPHNNHGYHLQSNKFSIYKGKWKRGSAQWRFTVYKR

SEQ ID NO: 113 - protein, 2354 aa, Bacillus amyloliquefaciens
MKIGKKNKWKKWLAGTLAATLMISIAPADVFAAETREKQDQAKTAAIPAADPEKDLPAEKAPEQMPFNQKDINQDGEITSERTENSKLYYEGEGVYKQEIYTDPIHTKETANADWEDVSPELKTGSKEVGTENTVLNSDFLKQIKNGLYATFEHDDHKLTYSLTGAKGPDQAAITPTDASAKVKGDSNELTYQQVFPAIDLQTYTFNENIKEDLVLHKYEGYNSFTFQIKTDLQAKEQEDGSIAFSDDKDNVVYTVPKPFMTDSDLDEKSGEVNRSEDVSFKLEKNSEGYLLHVTADEKWLKDPKRVYPVSIDPSTSVSVSSDTFVMSAYPTTNYSAASQKWDAGLKAYVLKTGYYDGTTGTNYAFMKFDNLKPIKNMTVTKATLKAYTAHSYYGSKATGLWLDTVNSNYDNAKITWKNKPGSKNIGKAEVYKGQWASFDVTSAVKSWNSGGANYGFKLHANGNGKEYWKKLMSSANSAKKPYIEVTYTIPKADTPSVKAYHNGDSTGFFNISWKKAEGAKSYKVWLYNGKEYQAIPVGNATSWSTKGKNIWPTKAEIDSGKYKLHTDGKGGSELALNPSPVYKNAGGSYPASKNYWVAVSAVFDQGEGAMSAAAKPVIPNIGRVQKPSTKGFNNNNATGWFDLSWKAVSGAAGYKMQVFNGKGFETLDLGNKTSWSTKDQNIWPTKAEISAGKYALHLKDKKGAELPINPGPVYKNAGGDANRKTYGFKVIAYNKDGEAIASPEASPALPDIAKPKNLTGYVYTNTKSSQTGYVNLIWDKVKNAKGYKINIYNGKDYQSFDVGDTDHWTTQNKRIWPSAEEVKAGRFQLHTDGKGGELALDPSPVYENANGNYKGKKNYSFTLTAYDANGDSIPTAPFNPVFHEGAEFLGTEEFWSIIDIPDGQLNGATGNVIVNEEDMSIDGRGPGLGLSRTFNSLDSSDHMFGQGWYADAETSILSEDGRAVYIDEDATTHVFTKKSDGTYQPPTGVYLELTETSDQFVLKTKDQTNAYFSKKGGKLQKIVDGHNNTTVYEYNDSNQLTAITDASGRKLTFTYDENGHVTSLTGPKNKKISYSYDKDLLKKVTDTDGSVTSYDYDAEGRLVKQYSANSTDDKPLFTEYQYSGHRLAKAVNAKKETYDYSYDADKKTLLMTQPNGRKVQYGYNEAGNPIQMIDDAEGLKITTNTVYEGNNVIQDTDPNDADAGKATESYQYDKDGNVTAVKDNYGTETYQYNKNNDVTKMKDTEGNVTDIAYDGLDAVSETDQSGKSSSAAVYDKYGNLIQSSKELAASASLLKDGSFEGTKLGWNLTATRDSGSIASVKARSGALSGQKALEISSQSASAGTEHGHASATQEVQLEPNTTYTLSGQIKTDLTKARAYFNIDLRDKDQKRIQWIHNESGALAGKNDWTKRQITFTTPANAGKAIVYMEVDHNDKDGKGKAWFDQVQLEKGEVSSSYNPVQNSSFTAKTDGWSTSGSAADLDEGFDDDSSLKASRTNASQANAAAKQTVTLGQSADDKPVYITLTGMSKADGVKLTNDNDYALQADVTYADGTTGVYTAKFPQGTQEWNRAAAVIPKTKPINRIEISILFQKSATGTAWFDDIRLIEGSILTKNTYDEKGNYVTKEEDELGYASTASYDETGKKMSETDAKGETTAYEYDQADQLTKLTLSNGTSILHSYDKEGNELTKTIRAGADQTYQYEYDVMGKLVKTTDPLGNVLKSEYDANSNLTKTVSANGNEVSLTYDGTDRVKSKAYNGTEKYNFTYDKNGNETSVTNKEQNTTKKRTFDNKNRLTELTDRGGSQSWTYPADSDKLKTFSWSHGGQKGTNSFTYNKLDQMIEMKDGTSAYTFDYDENGNVQTFISGNEVGTSFSYDERNLVSSLHIGAKNGGSIFRESYEYDANGNRTVIDSSAGGKVQYEYGKLNQLVKETHEDGTVIQYTYDGFGNRTNVTTTKDGASKSVNASFNIMNQLTKVNDEDLSYDKNGNRTSDGKFTYTWDAEDNLTAVTKKGEDKPFATYKYDEKGNRIQKTVNGNVTNYFYDGDSLNVLYETDADNNVTKSYTYGDSGQLLSYTKNGKKYFYHYNAHGDVIAITDSTGKTVAKYQYDAWGNPTKTEASDEVKDNRYRYAGYQYDEETGLYYLMARYYEPRNGVFLSLDPDPGSDGDSLDQNGYAYGNNNPVMNVDPDGHWVWLVVNAGFAAYDGYKAYKSGKGWRGAAWAAASNFGPGKLFKGASRVYKAVKSYKFVRKAKGGTYKGRLKSKYSKKRFVPDSYWSRKASHFGTPNSRITHYRLYKGRKERSTVIYDKYGRQKYRIDHSNHGMPRAHSKPHLHEYHFGRGYGPKGKNKTHNFWR

The invention claimed is:

1. A method for ascertaining Wap-compatibility of two *Bacillus amyloliquefaciens* strains, comprising:

a) determining whether the strains have a wapA nucleotide sequence or Wap A amino acid sequence by querying genomic sequences from the strains with one or more query sequences including SEQ ID NOs. 1-19 or SEQ ID NOs. 50-65, and identifying amino acid sequences having at least 95% sequence identity to one of the query sequences;

b) if a strain has a wapA nucleotide sequence or WapA amino acid sequence, determining whether the other of the two strains has a wapI nucleotide sequence or WapI amino acid sequence by querying the genomic sequences from the strains with one or more query sequences including SEQ ID NOs. 35-49 or SEQ ID NOs. 20-34, and identifying amino acid sequences having at least 95% sequence identity to one of the query sequences;

c) designating the two strains as Wap compatible if:

i) neither of the two strains has a wapA nucleotide sequence or WapA amino acid sequence; or ii) a strain has a wapA nucleotide sequence or WapA amino acid sequence and the other of the two strains has a wapI nucleotide sequence or WapI amino acid sequence, the sequences from the two strains are from the same Wap Group; and d) if the two strains are not designated as Wap compatible in step (c), designating the two strains as Wap non-compatible.

2. The method of claim 1, where if the two strains are determined to be Wap compatible, placing the compatible strains into a composition or supplying the compatible strains to a plant.

* * * * *